United States Patent
Kanner et al.

(10) Patent No.: US 9,803,205 B2
(45) Date of Patent: Oct. 31, 2017

(54) COMPOSITIONS AND METHODS FOR INHIBITING GENE EXPRESSION OF FACTOR XII

(71) Applicant: Arrowhead Madison Inc., Madison, WI (US)

(72) Inventors: Steven B. Kanner, Madison, WI (US); David L. Lewis, Madison, WI (US); Darren H. Wakefield, Fitchburg, WI (US); Lauren J. Almeida, Madison, WI (US)

(73) Assignee: Arrowhead Pharmaceuticals, Inc., Pasadena, CA (US)

( * ) Notice: Subject to any disclaimer, the term of this patent is extended or adjusted under 35 U.S.C. 154(b) by 0 days.

(21) Appl. No.: 15/071,634

(22) Filed: Mar. 16, 2016

(65) Prior Publication Data
US 2016/0272978 A1   Sep. 22, 2016

Related U.S. Application Data

(60) Provisional application No. 62/134,186, filed on Mar. 17, 2015.

(51) Int. Cl.
| | |
|---|---|
| *C12N 15/113* | (2010.01) |
| *A61K 47/48* | (2006.01) |
| *A61K 31/713* | (2006.01) |
| *A61K 47/42* | (2017.01) |
| *A61K 9/00* | (2006.01) |

(52) U.S. Cl.
CPC ........ *C12N 15/1137* (2013.01); *A61K 31/713* (2013.01); *A61K 47/42* (2013.01); *A61K 47/48123* (2013.01); *C12N 15/113* (2013.01); *A61K 9/0019* (2013.01); *C12N 2310/14* (2013.01); *C12N 2310/315* (2013.01); *C12N 2310/322* (2013.01); *C12N 2310/351* (2013.01); *C12N 2310/3515* (2013.01); *C12N 2320/30* (2013.01)

(58) Field of Classification Search
CPC ................ C12N 15/111; C12N 15/113; C12N 2310/344; A61K 31/713
See application file for complete search history.

(56) References Cited

U.S. PATENT DOCUMENTS

| | | | |
|---|---|---|---|
| 5,885,968 A | 3/1999 | Biessen et al. | |
| 8,084,599 B2 | 12/2011 | Rossi et al. | |
| 8,349,809 B2 | 1/2013 | Brown | |
| 8,513,207 B2 | 8/2013 | Brown | |

FOREIGN PATENT DOCUMENTS

| | | |
|---|---|---|
| WO | 0053722 A2 | 9/2000 |
| WO | 2008022309 A2 | 2/2008 |
| WO | 2011104169 A1 | 9/2011 |
| WO | 2012083185 A2 | 6/2012 |

OTHER PUBLICATIONS

Baenziger Ju et al. "Galactose and N-acetylgalactosamine-specific endocytosis of glycopeptides by isolated rat hepatocytes" Cell 1980, 22(2): 611-620.
Biessen et al. "Synthesis of Cluster Galactosides with High Affinity for the Hepatic Asialoglycoprotein Receptor" Journal of Medicinal Chemistry (1995) 38(9): 1538-1546.
Connolly et al. "Binding and endocytosis of cluster glycosides by rabbit hepatocytes. Evidence for a short-circuit pathway that does not lead to degradation" Journal of Biological Chemistry (1982) 257(2): 939-945.
Iobst et al. "Selective Sugar Binding to the Carbohydrate Recognition Domains of the Rat Hepatic and Macrophage Asialoglycoprotein Receptors." Journal of Biological Chemistry (1996) 271(12), p. 6686-6693.
Kenniston et al.; "Inhibition of Plasma Kallikrein by a Highly Specific Active Site Blocking Antibody"; The Journal of Biological Chemistry; 2014; vol. 289; No. 34; pp. 23596-23608.
Larsson et al.; "A Factor XIIa Inhibitory Antibody Provides Thromboprotection in Extracorporeal Circulation Without Increasing Bleeding Risk"; Science Translational Medicine; vol. 6; Issue 222; pp. 222ra17; (2014).
Livak and Schmittgen; "Analysis of Relative Gene Expression Data Using Real-Time Quantitative PCR and the 2(-Delta Delta C(T)) Method"; Methods 25; 402-408; (2001).
Renne, et al.; "Defective thrombus formation in mice lacking coagulation factor XII"; JEM; 202(2); pp. 271-281; (2005).
GenBank Accession No. NM_000505 (Retrieved Jun. 20, 2016).

*Primary Examiner* — Jon E Angell
(74) *Attorney, Agent, or Firm* — Robert Michael Teigen

(57) ABSTRACT

RNA interference (RNAi) triggers for inhibiting the expression of Factor XII (F12) gene through the mechanism of RNA interference are described. Pharmaceutical compositions comprising one or more F12 RNAi triggers together with one or more excipients capable of delivering the RNAi trigger(s) to a liver cell in vivo are also described. Delivery of the F12 RNAi trigger(s) to liver cells in vivo provides for inhibition of F12 gene expression and treatment of angioedema, including hereditary angioedema (HAE) and venous thromboembolism (VTE), and diseases associated with angioedema.

25 Claims, 8 Drawing Sheets

A.

B.

A.

B.

A.

B.

A.

B.

C.

COMPOSITIONS AND METHODS FOR INHIBITING GENE EXPRESSION OF FACTOR XII

PRIORITY

The present application claims the benefit of U.S. Provisional Patent Application No. 62/134,186, filed Mar. 17, 2015, the contents of which are incorporated herein in its entirety.

BACKGROUND

Factor XII, a serine protease expressed predominantly in the liver and found in blood, has dual functions in both the intrinsic coagulation pathway and the kinin-kallikrein system. The kinin-kallikrein system plays a role in inflammation, blood pressure control, coagulation and pain. The active form of Factor XII (also referred to as FXII, F12, or Hageman factor) binds and cleaves both Factor XI in the coagulation cascade and prekallikrein in the kinin-kininogen system, yielding the active forms FXI and kallikrein, respectively.

Patients with complete loss of F12 do not present with a bleeding disorder. Further, mice lacking F12 by gene knockout are protected from thrombosis (Renne et al JEM 2005, 202:271-281). The thrombo-protective effect of F12 depletion was also observed in F12-inhibitory antibody treated mice, rabbits and primates (Larsson et al. ScienceTransMed, 2014 6:22ra17). Current treatments for thromboembolic events target enzymes downstream in the coagulation pathway that are critical for controlling injury-related blood loss through fibrin formation, and therefore, treatment with these agents have the downside of potential life-threatening hemorrhage.

Hereditary angioedema (HAE) is a rare disease characterized by recurrent episodes of severe swelling. The most common areas of the body to develop swelling are the limbs, face, intestinal tract, and airway. Episodes may be spontaneous or be induced by physical trauma or stress. Laryngeal (airway) edema can be life-threatening, as it can lead to death by asphyxiation.

The majority of HAE treatment options are for administration at the time of attack, focusing on either C1INH replacement, inhibiting kallikrein, or signaling through the bradykinin 2 receptor. Currently, the only long-term prophylactic treatment is C1INH replacement therapy. Because both thrombosis (including venous thromboembolism, VTE) and angioedema are thought to occur through overactive signaling of their respective pathways, inhibition of F12 gene expression would be useful in preventing both types of disorders.

SUMMARY

Described herein are F12 RNA interference (RNAi) triggers and compositions thereof for inhibiting expression of the F12 gene in vivo. The F12 RNAi triggers described herein can be used for treating diseases caused by over-activation of the kinin-kallikrein and intrinsic coagulation pathways, such as HAE and thrombosis.

Described herein are Factor XII (also termed Factor 12, F12, or Hageman factor) gene-specific RNA interference (RNAi) trigger molecules (also termed RNAi agent, RNAi trigger, or trigger) able to selectively and efficiently decrease expression of F12. Use of the described F12 RNAi triggers can be used in methods for therapeutic treatment of diseases associated with angioedema, including but not limited to: hereditary angioedema (HAE), acquired angioedema (AAE), ACE inhibitor associated angioedema, allergic angioedema, nonhistaminergic angioedema (INAE), idiopathic angioedema, thrombosis, venous thromboembolism (VTE), thrombotic occlusive disease, peri-operative venous occlusive disease prophylaxis. Use of the described F12 RNAi triggers further provides methods for the treatment and prevention of venous occlusive disease such as deep venous thrombosis or pulmonary embolism, and treatment or prevention of arterial thromboembolic disease. Such methods comprise administration of an F12 RNAi trigger as described herein to a subject, e.g., a human or animal subject.

RNAi triggers for inhibiting expression of the human F12 gene (F12 RNAi triggers) are described herein. Each RNAi trigger includes at least a sense strand and an antisense strand. The sense strand and the antisense strand can be partially, substantially, or fully complementary to each other. The length of the RNAi trigger sense and antisense strands described herein each can be 16 to 30 nucleotides in length. In some embodiments, the sense and antisense strands each can be 17 to 26 nucleotides in length. The sense and antisense strands can be either the same length or different lengths. In some embodiments, both the sense and antisense strands each can be 26 nucleotides in length. In other embodiments, the sense strand is about 23 nucleotides in length while the antisense strand is about 21 nucleotides in length. In some embodiments, the sense and antisense strands are 17 nucleotides in length. The RNAi triggers described herein, upon delivery to a cell expressing the F12 gene, inhibit the expression of the F12 gene in vitro or in vivo.

A sense strand of the F12 RNAi triggers described herein contains a nucleotide sequence having at least 90% identity to a sequence in an F12 mRNA. In some embodiments, the nucleotide sequence having at least 90% identity to a sequence in an F12 mRNA is 16, 17, 18, 19, 20, 21, 22, 23, 24, 25, or 26 nucleotides in length. An antisense strand of the F12 RNAi triggers described herein contains a nucleotide sequence having at least 90% complementary to a sequence in an F12 mRNA. In some embodiments, the nucleotide sequence having at least 90% complementarity to a sequence in an F12 mRNA is 16, 17, 18, 19, 20, 21, 22, 23, 24, 25, or 26 nucleotides in length. Examples of F12 RNAi trigger sense strands and antisense strands that can be used in a F12 RNAi trigger are provided in Tables 1-3.

In some embodiments, one or more F12 RNAi triggers are delivered to target cells or tissues using any oligonucleotide delivery technology known in the art. Nucleic acid delivery methods include, but are not limited to, by encapsulation in liposomes, by iontophoresis, or by incorporation into other vehicles, such as hydrogels, cyclodextrins, biodegradable nanocapsules, and bioadhesive microspheres, proteinaceous vectors or DPCs (see, for example WO 2000/053722, WO 2008/0022309, WO 2011/104169, and WO 2012/083185, each of which is incorporated herein by reference). In some embodiments, an F12 RNAi trigger is covalently linked to a targeting group. The targeting group can include a cell receptor ligand, such as a galactose cluster, including a galactose cluster comprised of an N-acetyl-galactosamine trimer, or a hydrophobic group, such as a cholesterol. In some embodiments, an F12 RNAi trigger is provided with an in vivo delivery compound or vehicle. The delivery compound or vehicle can include a polymer, such as a melittin-like peptide (MLP) delivery polymer or copolymer.

In some embodiments, an F12 RNAi trigger can be covalently linked to a delivery compound or vehicle.

The F12 RNAi triggers or pharmaceutical compositions containing one or more F12 RNAi triggers can be administered in a number of ways depending upon whether local or systemic treatment is desired and upon the area to be treated. In some embodiments, administration is topical (e.g., by a transdermal patch), pulmonary, e.g., by inhalation or insufflation of powders or aerosols, including by nebulizer: intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Other features and advantages of the invention will be apparent from the following detailed description, and from the claims.

DETAILED DESCRIPTION

Figure 1:
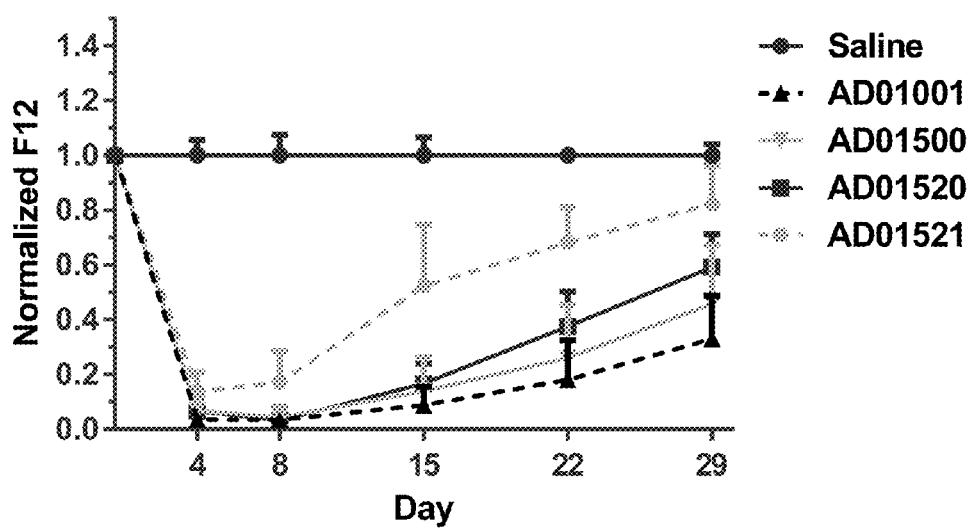
FIG. 1. Graphs showing: A. Serum F12 protein levels in wild-type mice following administration of 2 mg/kg RNAi trigger with 2 mg/kg MLP delivery polymer, and B. Serum F12 protein levels in wild-type mice following administration of 4 mg/kg RNAi trigger with 4 mg/kg MLP delivery polymer. mF12 levels were normalized to day 1 and saline control.
Figure 1:
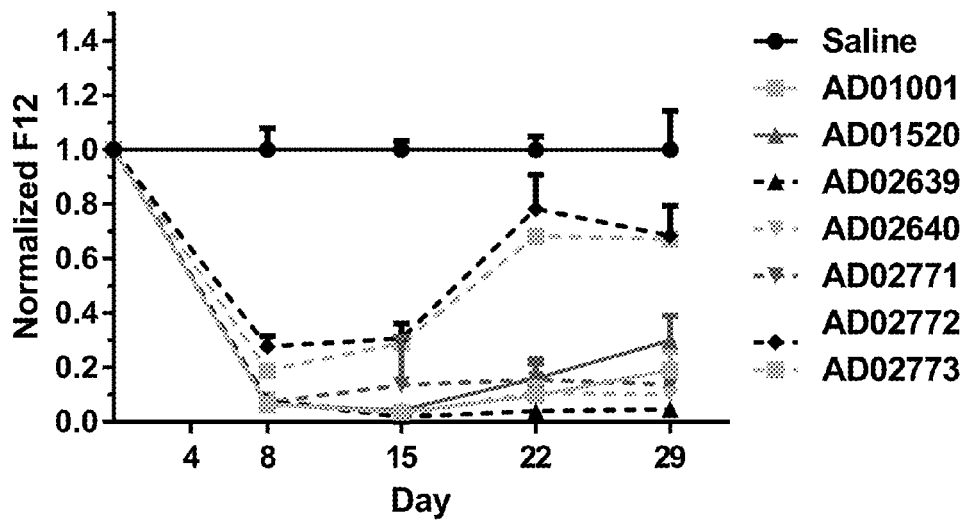

Described herein are RNAi triggers for inhibiting expression of the Factor XII gene (referred to herein as F12 RNAi triggers). An F12 RNAi triggers each comprise a sense strand and an antisense strand. The sense strand and the antisense strand are partially, substantially, or fully complementary to each other. In some embodiments, the length of the herein described RNAi trigger sense and antisense strands are independently 16 to 30 nucleotides in length. In some embodiments, the length of the herein described RNAi trigger sense and antisense strands are independently 17 to 26 nucleotides in length. In some embodiments, the herein described RNAi trigger sense and antisense strands are independently 17, 18, 19, 20, 21, 22, 23, 24, 25, or 26 nucleotides in length. The sense and antisense strands can be either the same length or they can be different lengths. In some embodiments, both the sense and antisense strands are each 26 nucleotides in length. In other embodiments, the sense strand is about 23 nucleotides in length while the antisense strand is about 21 nucleotides in length. In other embodiments, the sense and antisense strands are independently 17-21 nucleotides in length. Examples of nucleotide sequences used in forming F12 RNAi trigger molecules are provided in Tables 1-3.

RNAi triggers include, but are not limited to: short interfering RNAs (siRNAs), double-strand RNAs (dsRNA), micro RNAs (miRNAs), short hairpin RNAs (shRNA), and dicer substrates (U.S. Pat. Nos. 8,084,599 8,349,809 and 8,513,207). The RNAi triggers described herein, upon delivery to a cell expressing the F12 gene, inhibit or knockdown expression of F12 gene in vitro or in vivo through the biological process of RNA interference (RNAi).

An F12 RNAi trigger comprises a sense strand and an antisense strand each containing a core sequence of 16-23 nucleobases in length. An antisense strand core sequence is 1000/(perfectly) complementary or at least 90% (substantially) complementary to a nucleotide sequence (sometimes referred to, e.g. as a target sequence) present in the F12 mRNA. A sense strand core sequence is 100% (perfectly) complementary or at least 90% (substantially) complementary to a sequence in the antisense strand and thus the sense strand core sequence is perfectly identical or at least 90% identical to a nucleotide sequence (target sequence) present in the F12 mRNA. A sense strand core sequence can be the same length as a corresponding antisense core sequence or it can be a different length. In some embodiments, the antisense strand core sequence is 17, 18, 19, 20, 21, 22, or 23 nucleotides in length. In some embodiments, the sense strand core sequence is 17, 18, 19, 20, 21, 22, or 23 nucleotides in length.

The F12 RNAi trigger sense and antisense strands typically anneal to form a duplex. Within the complementary duplex region, the sense strand core sequence is at least 90% complementary or 100% complementary to the antisense core sequence. In some embodiments, the sense strand core sequence contains a sequence of at least 16, at least 17, at least 18, at least 19, at least 20, or at least 21 nucleotides that is at least 90% or 100% complementary to a corresponding 16, 17, 18, 19, 20, or 21 nucleotide sequence of the antisense strand core sequence (i.e., the sense strand and antisense core sequences of an F12 RNAi trigger have a region of at least 16, at least 17, at least 18, at least 19, at least 20, or at least 21 nucleotides that is at least 90% base paired or 100% base paired.)

The sense strand and/or the antisense strand may optionally and independently contain an additional 1, 2, 3, 4, 5, or 6 nucleotides (extension) at the 3' end, the 5' end, or both the 3' and 5' ends of the core sequences. The antisense strand additional nucleotides, if present, may or may not be complementary to the corresponding sequence in the F12 mRNA. The sense strand additional nucleotides, if present, may or may not be identical to the corresponding sequence in the F12 mRNA. The antisense strand additional nucleotides, if present, may or may not be complementary to the corresponding sense strands additional nucleotides, if present.

As used herein, an extension comprises 1, 2, 3, 4, 5, or 6 nucleotides at the 5' and/or 3' end of the sense strand core sequence and/or antisense strand core sequence. The extension nucleotides on a sense strand may or may not be complementary to nucleotides, either core sequence nucleotides or extension nucleotides, in the corresponding antisense strand. Conversely, the extension nucleotides on an antisense strand may or may not be complementary to nucleotides, either core sequence nucleotides or extension nucleotides, in the corresponding sense strand. In some embodiments, both the sense strand and the antisense strand of an RNAi trigger contain 3' and 5' extensions. In some embodiments, one or more of the 3' extension nucleotides of one strand base pairs with one or more 5' extension nucleotides of the other strand. In other embodiments, one or more of 3' extension nucleotides of one strand do not base pair with one or more 5' extension nucleotides of the other strand. In some embodiments, an F12 RNAi trigger has an antisense strand having a 3' extension and a sense strand having a 5' extension.

In some embodiments an F12 RNAi trigger molecule comprises an antisense strand having a 3' extension of 1, 2, 3, 4, 5, or 6 nucleotides in length. In other embodiments, an F12 RNAi trigger molecule comprises an antisense strand having a 3' extension of 1, 2, or 3 nucleotides in length. In some embodiments, one or more of the antisense strand extension nucleotides comprise uracil or thymidine nucleotides or nucleotides which are complementary to the corresponding F12 mRNA sequence. In some embodiments, the antisense strand extension can be, but is not limited to: uAu, uGu, udTsdT, usdTsdT, UfAu, Aua, Afsusa, UAU, uAfu, uau, udAu, uscu, usgu, uscsu, cAu, aUa, aua, u(invdA)u, cag, agu, gcg, caa, usasu, uAMTM, usTMsAM (each listed 5' to 3', notation is the same as for Tables 2 and 3).

In some embodiments, an F12 RNAi trigger molecule comprises an antisense strand having a 5' extension of 1, 2, 3, 4, or 5 nucleotides in length. In other embodiments, an F12 RNAi trigger molecule comprises an antisense strand having a 5' extension of 1 or 2 nucleotides in length.

In some embodiments, one or more of the antisense strand extension nucleotides comprises uracil or thymidine nucleotides or nucleotides which are complementary to the corresponding F12 mRNA sequence. In other embodiments, the antisense strand extension includes or consists of dA, dT, pdT, vpdT, or u, wherein dA and dT represent deoxyadenosine and deoxythimidine nucleotides respectively, pdT represents a deoxythimidine nucleotide having a 5' phosphosphate, vpdT represents a vinylphosphonate deoxythimidine nucleotide, and u represents a 2'-OMe modified uracil nucleotide. An antisense strand may have any of the 3' extensions described above in combination with any of the 5' antisense strand extensions described, if present.

In some embodiments, an F12 RNAi trigger molecule comprises a sense strand having a 3' extension of 1, 2, 3, 4, or 5 nucleotides in length. In some embodiments, one or more of the sense strand extension nucleotides comprises adenosine, uracil, or thymidine nucleotides, AT dinucleotide, or nucleotides which correspond to nucleotides in the F12 mRNA sequence. In other embodiments, the 3' sense strand extension consists of Af, invdA, invdT, A(invdT), Af(invdT), U(invdT), Uf(invdT), AfAbuAu, dTdT, or dTsdT, wherein Af and Uf represent 2'-fluoro adenosine and uracil nucleotides respectively, invdA and invdT represent 3'-3' linked (inverted) deoxyadenosine and deoxythimidine nucleotides respectively, Ab represents an abasic ribose, u represents a 2'-OMe modified uracil nucleotide, dT represents a deoxythimidine nucleotide, sdT represents a deoxythimidine nucleotide having a 5' phosphorothioate, and U and A represent uracil and adenosine ribonucleotides.

In some embodiments, an F12 RNAi trigger molecule comprises a sense strand having a 5' extension of 1, 2, 3, 4, 5, or 6 nucleotides in length. In some embodiments, one or more of the sense strand extension nucleotides comprise uracil or adenosine nucleotides or nucleotides which correspond to nucleotides in the F12 mRNA sequence. In some embodiments, the sense strand 5' extension can be, but is not limited to: uAuAus, uAuAu, UAUUAGfs, UfaUfaA, uauaA, AUAUU, AfuAfuU, auauU, uaUfau, uAuA($U_{UNA}$), uauau, udAudAu, uuAga, uuAuu, uuGAu, uuaga, uAuga, aUaGas, uauaus, uAuaas, udAuau, adTaga, auaga, u(invdA)uau, gacau, ugaau, gcgau, uauga, uugga, auaga (each listed 5' to 3', notation is the same as for Tables 2 and 3). A sense strand may have a 3' extension and/or a 5' extension.

Unmodified F12 RNAi trigger sense strand and antisense strand sequences are provided in Table 1. Note that in each row, the antisense strand is not necessarily shown with the corresponding (complementary) sense strand. In forming F12 RNAi triggers, each of the nucleotides in each of the sequences listed in Table 1 may be a modified nucleotide.

TABLE 1

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 1 | TGGUGGUAGCACACCAGGGTT | 225 | CCCUGGUGUGCUACCACCAT |
| 2 | TGGGUGGUAGCACACCAGGTT | 226 | CCUGGUGUGCUACCACCCAT |
| 3 | TGGGGUGGUAGCACACCAGTT | 227 | CUGGUGUGCUACCACCCCAT |
| 4 | TCACUUUCUUGGGCUCCAATT | 228 | UUGGAGCCCAAGAAAGUGAT |
| 5 | TUCACUUUCUUGGGCUCCATT | 229 | UGGAGCCCAAGAAAGUGAAT |
| 6 | TUUCACUUUCUUGGGCUCCTT | 230 | GGAGCCCAAGAAAGUGAAAT |
| 7 | TUUUCACUUUCUUGGGCUCTT | 231 | GAGCCCAAGAAAGUGAAAAT |
| 8 | TCUUUCACUUUCUUGGGCUTT | 232 | AGCCCAAGAAAGUGAAAGAT |
| 9 | TUCUUUCACUUUCUUGGGCTT | 233 | GCCCAAGAAAGUGAAAGAAT |
| 10 | TGUCUUUCACUUUCUUGGGTT | 234 | CCCAAGAAAGUGAAAGACAT |
| 11 | TGGUCUUUCACUUUCUUGGTT | 235 | CCAAGAAAGUGAAAGACCAT |
| 12 | TGGUCUUUCACUUUCUUGTT | 236 | CAAGAAAGUGAAAGACCAAT |
| 13 | TAGCUGAGGCUCAAAGCACTT | 237 | GUGCUUUGAGCCUCAGCUAT |
| 14 | TAAGCUGAGGCUCAAAGCATT | 238 | UGCUUUGAGCCUCAGCUUAT |
| 15 | TGAAGCUGAGGCUCAAAGCTT | 239 | GCUUUGAGCCUCAGCUUCAT |
| 16 | TGAGAAGCUGAGGCUCAAATT | 240 | UUUGAGCCUCAGCUUCUCAT |
| 17 | TGCAGGCCUGGCUGGCCAGTT | 241 | CUGGCCAGCCAGGCCUGCAT |
| 18 | TGCCCCCUCGAACUGGUGGTT | 242 | CCACCAGUUCGAGGGGGCAT |
| 19 | TUUGCGGUCACCACAGCCCTT | 243 | GGGCUGUGGUGACCGCAAAT |
| 20 | TGUUGCGGUCACCACAGCCTT | 244 | GGCUGUGGUGACCGCAACAT |
| 21 | TUGUUGCGGUCACCACAGCTT | 245 | GCUGUGGUGACCGCAACAAT |
| 22 | TUUGUUGCGGUCACCACAGTT | 246 | CUGUGGUGACCGCAACAAAT |
| 23 | TCUUGUUGCGGUCACCACATT | 247 | UGUGGUGACCGCAACAAGAT |
| 24 | TGCUUGUUGCGGUCACCACTT | 248 | GUGGUGACCGCAACAAGCAT |
| 25 | TGGCUUGUUGCGGUCACCATT | 249 | UGGUGACCGCAACAAGCCAT |
| 26 | TAAGCACUUUAUUGAGUUCTT | 250 | GAACUCAAUAAAGUGCUUAT |
| 27 | TAAAGCACUUUAUUGAGUUTT | 251 | AACUCAAUAAAGUGCUUUAT |
| 28 | TCAAAGCACUUUAUUGAGUTT | 252 | ACUCAAUAAAGUGCUUUGAT |
| 29 | TUCAAAGCACUUUAUUGAGTT | 253 | CUCAAUAAAGUGCUUUGAAT |
| 30 | TUUCAAAGCACUUUAUUGATT | 254 | UCAAUAAAGUGCUUUGAAAT |
| 31 | TUUUCAAAGCACUUUAUUGTT | 255 | CAAUAAAGUGCUUUGAAAAT |
| 32 | TUUUUCAAAGCACUUUAUUTT | 256 | AAUAAAGUGCUUUGAAAAAT |
| 33 | TCAUCCGUCCGUUGGUCCATT | 257 | UGGACCAACGGACGGAUGAT |
| 34 | TGCAUCCGUCCGUUGGUCCTT | 258 | GGACCAACGGACGGAUGCAT |
| 35 | TGGCAUCCGUCCGUUGGUCTT | 259 | GACCAACGGACGGAUGCCAT |
| 36 | TUGGCAUCCGUCCGUUGGUTT | 260 | ACCAACGGACGGAUGCCAAT |
| 37 | TAUGGCAUCCGUCCGUUGGTT | 261 | CCAACGGACGGAUGCCAUAT |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 38 | TCAUGGCAUCCGUCCGUUGTT | 262 | CAACGGACGGAUGCCAUGAT |
| 39 | TUCAUGGCAUCCGUCCGUUTT | 263 | AACGGACGGAUGCCAUGAAT |
| 40 | TCUCAUGGCAUCCGUCCGUTT | 264 | ACGGACGGAUGCCAUGAGAT |
| 41 | TCAGAGCCCUCAUGGCAUCTT | 265 | GAUGCCAUGAGGGCUCUGAT |
| 42 | TGCAGAGCCCUCAUGGCAUTT | 266 | AUGCCAUGAGGGCUCUGCAT |
| 43 | TACCCCAGGAGCAGCAGAGTT | 267 | CUCUGCUGCUCCUGGGGUAT |
| 44 | TGGGAAGUGGCAGGGCUCCTT | 268 | GGAGCCCUGCCACUUCCCAT |
| 45 | TUGGUACAGCUGCCGGUGGTT | 269 | CCACCGGCAGCUGUACCAAT |
| 46 | TCUGGUCCUGAUCAAAGUUTT | 270 | AACUUUGAUCAGGACCAGAT |
| 47 | TGCUGGUCCUGAUCAAAGUTT | 271 | ACUUUGAUCAGGACCAGCAT |
| 48 | TUCGCUGGUCCUGAUCAAATT | 272 | UUUGAUCAGGACCAGCGAAT |
| 49 | TCCAUCGCUGGUCCUGAUCTT | 273 | GAUCAGGACCAGCGAUGGAT |
| 50 | TCCCAUCGCUGGUCCUGAUTT | 274 | AUCAGGACCAGCGAUGGGAT |
| 51 | TUCCCCAUCGCUGGUCCUGTT | 275 | CAGGACCAGCGAUGGGGAAT |
| 52 | TCUUUCUUGGGCUCCAAACTT | 276 | GUUUGGAGCCCAAGAAAGAT |
| 53 | TACUUUCUUGGGCUCCAAATT | 277 | UUUGGAGCCCAAGAAAGUAT |
| 54 | TCUGAGCCCGCGGCCAUCATT | 278 | UGAUGGCCGCGGGCUCAGAT |
| 55 | TUCCGAGGCCCACGGCUGATT | 279 | UCAGCCGUGGGCCUCGGAAT |
| 56 | TCUCCGAGGCCCACGGCUGTT | 280 | CAGCCGUGGGCCUCGGAGAT |
| 57 | TCCUCCGAGGCCCACGGCUTT | 281 | AGCCGUGGGCCUCGGAGGAT |
| 58 | TGGUGGCCUCCGAGGCCCATT | 282 | UGGGCCUCGGAGGCCACCAT |
| 59 | TAGGUGGCCUCCGAGGCCCTT | 283 | GGGCCUCGGAGGCCACCUAT |
| 60 | TUAGGUGGCCUCCGAGGCCTT | 284 | GGCCUCGGAGGCCACCUAAT |
| 61 | TGUAGGUGGCCUCCGAGGCTT | 285 | GCCUCGGAGGCCACCUACAT |
| 62 | TGUCCCCAGUUCCGCGCUUTT | 286 | AAGCGCGGAACUGGGGACAT |
| 63 | TUUCCGGCAGAAGGCGUGGTT | 287 | CCACGCCUUCUGCCGGAAAT |
| 64 | TGUUCCGGCAGAAGGCGUGTT | 288 | CACGCCUUCUGCCGGAACAT |
| 65 | TGGUUCCGGCAGAAGGCGUTT | 289 | ACGCCUUCUGCCGGAACCAT |
| 66 | TCCGGGUUCCGGCAGAAGGTT | 290 | CCUUCUGCCGGAACCCGGAT |
| 67 | TUCCGGGUUCCGGCAGAAGTT | 291 | CUUCUGCCGGAACCCGGAAT |
| 68 | TGUCCGGGUUCCGGCAGAATT | 292 | UUCUGCCGGAACCCGGACAT |
| 69 | TUGUCCGGGUUCCGGCAGATT | 293 | UCUGCCGGAACCCGGACAAT |
| 70 | TCGUUGUCCGGGUUCCGGCTT | 294 | GCCGGAACCCGGACAACGAT |
| 71 | TUCGUUGUCCGGGUUCCGGTT | 295 | CCGGAACCCGGACAACGAAT |
| 72 | TUUCCUGGUCAGGGAAGGCTT | 296 | GCCUUCCCUGACCAGGAAAT |
| 73 | TGUUCCUGGUCAGGGAAGGTT | 297 | CCUUCCCUGACCAGGAACAT |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 74 | TCGUUCCUGGUCAGGGAAGTT | 298 | CUUCCCUGACCAGGAACGAT |
| 75 | TCCGUUCCUGGUCAGGGAATT | 299 | UUCCCUGACCAGGAACGGAT |
| 76 | TGCCGUUCCUGGUCAGGGATT | 300 | UCCCUGACCAGGAACGGCAT |
| 77 | TCAGUGGGCCGUUCCUGGUTT | 301 | ACCAGGAACGGCCCACUGAT |
| 78 | TAGCUCAGUGGGCCGUUCCTT | 302 | GGAACGGCCCACUGAGCUAT |
| 79 | TGAAGACAGACUCUUGCGGTT | 303 | CCGCAAGAGUCUGUCUUCAT |
| 80 | TUGCCGGCGCAGAAACUGUTT | 304 | ACAGUUUCUGCGCCGGCAAT |
| 81 | TGGCGAUGAGGCUGCCGGCTT | 305 | GCCGGCAGCCUCAUCGCCAT |
| 82 | TGGGCGAUGAGGCUGCCGGTT | 306 | CCGGCAGCCUCAUCGCCCAT |
| 83 | TGGGGCGAUGAGGCUGCCGTT | 307 | CGGCAGCCUCAUCGCCCCAT |
| 84 | TACCCAGCAGGGGGCGAUGTT | 308 | CAUCGCCCCUGCUGGGUAT |
| 85 | TGCACCCAGCAGGGGGCGATT | 309 | UCGCCCCUGCUGGGUGCAT |
| 86 | TAGCACCCAGCAGGGGGCGTT | 310 | CGCCCCUGCUGGGUGCUAT |
| 87 | TUCAGCACCCAGCAGGGGGTT | 311 | CCCCCUGCUGGGUGCUGAAT |
| 88 | TCCGAGCACCACCGUCAGATT | 312 | UCUGACGGUGGUGCUCGGAT |
| 89 | TGGCCGAGCACCACCGUCATT | 313 | UGACGGUGGUGCUCGGCCAT |
| 90 | TUGGCCGAGCACCACCGUCTT | 314 | GACGGUGGUGCUCGGCCAAT |
| 91 | TUCCUGGCCGAGCACCACCTT | 315 | GGUGGUGCUCGGCCAGGAAT |
| 92 | TCAGCUGCCGUCCGCAUCCTT | 316 | GGAUGCGGACGGCAGCUGAT |
| 93 | TGGAGCGCGCAGCUGCCGUTT | 317 | ACGGCAGCUGCGCGCUCCAT |
| 94 | TACGUAAGGCGACAGGAGCTT | 318 | GCUCCUGUCGCCUUACGUAT |
| 95 | TCUGAACGUAAGGCGACAGTT | 319 | CUGUCGCCUUACGUUCAGAT |
| 96 | TCUGGCAUAUUCCUCCGCCTT | 320 | GGCGGAGGAAUAUGCCAGAT |
| 97 | TAGCUGGCAUAUUCCUCCGTT | 321 | CGGAGGAAUAUGCCAGCUAT |
| 98 | TGAAGCUGGCAUAUUCCUCTT | 322 | GAGGAAUAUGCCAGCUUCAT |
| 99 | TGGAAGCUGGCAUAUUCCUTT | 323 | AGGAAUAUGCCAGCUUCCAT |
| 100 | TCGGGCCUCCGGAAUCACCTT | 324 | GGUGAUUCCGGAGGCCCGAT |
| 101 | TGCCACUCUCUCACUGCGGTT | 325 | CCGCAGUGAGAGAGUGGCAT |
| 102 | TAGCCACUCUCUCACUGCGTT | 326 | CGCAGUGAGAGAGUGGCUAT |
| 103 | TAACAGAGCCGUCAUGGCGTT | 327 | CGCCAUGACGGCUCUGUUAT |
| 104 | TCAACAGAGCCGUCAUGGCTT | 328 | GCCAUGACGGCUCUGUUGAT |
| 105 | TACAACAGAGCCGUCAUGGTT | 329 | CCAUGACGGCUCUGUUGUAT |
| 106 | TAACAACAGAGCCGUCAUGTT | 330 | CAUGACGGCUCUGUUGUUAT |
| 107 | TGAACAACAGAGCCGUCAUTT | 331 | AUGACGGCUCUGUUGUUCAT |
| 108 | TGGAACAACAGAGCCGUCATT | 332 | UGACGGCUCUGUUGUUCCAT |
| 109 | TCGGUGGUACUGAAAGGGATT | 333 | UCCCUUUCAGUACCACCGAT |
| 110 | TUUGUGGAUGCAUUUGUGGTT | 334 | CCACAAAUGCAUCCACAAAT |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 111 | TCAAGCAGUAUCCCCAUUGTT | 335 | CAAUGGGGAUACUGCUUGAT |
| 112 | TCUCCAAGCAGUAUCCCCATT | 336 | UGGGGAUACUGCUUGGAGAT |
| 113 | TGCUCCAAGCAGUAUCCCCTT | 337 | GGGGAUACUGCUUGGAGCAT |
| 114 | TGGGCUCCAAGCAGUAUCCTT | 338 | GGAUACUGCUUGGAGCCCAT |
| 115 | TGUGUUUGCUGCAAUGGUCTT | 339 | GACCAUUGCAGCAAACACAT |
| 116 | TUUCCGGUAGGUGGCCUCCTT | 340 | GGAGGCCACCUACCGGAAAT |
| 117 | TGUUCCGGUAGGUGGCCUCTT | 341 | GAGGCCACCUACCGGAACAT |
| 118 | TUGUUCCGGUAGGUGGCCUTT | 342 | AGGCCACCUACCGGAACAAT |
| 119 | TCUCAGUCAUGUUCCGGUATT | 343 | UACCGGAACAUGACUGAGAT |
| 120 | TGACGUGUGUCAUUAUCUGTT | 344 | CAGAUAAUGACACACGUCAT |
| 121 | TGGACGUGUGUCAUUAUCUTT | 345 | AGAUAAUGACACACGUCCAT |
| 122 | TUGGACGUGUGUCAUUAUCTT | 346 | GAUAAUGACACACGUCCAAT |
| 123 | TAUGGACGUGUGUCAUUAUTT | 347 | AUAAUGACACACGUCCAUAT |
| 124 | TACCAUGGACGUGUGUCAUTT | 348 | AUGACACGUCCAUGGUAT |
| 125 | TAGUCCGCCCACCACGCGCTT | 349 | GCGCGUGGUGGGCGGACUAT |
| 126 | TUAGUCCGCCCACCACGCGTT | 350 | CGCGUGGUGGGCGGACUAAT |
| 127 | TCUAGUCCGCCCACCACGCTT | 351 | GCGUGGUGGGCGGACUAGAT |
| 128 | TACUAGUCCGCCCACCACGTT | 352 | CGUGGUGGGCGGACUAGUAT |
| 129 | TCAGAGCCACUAGUCCGCCTT | 353 | GGCGGACUAGUGGCUCUGAT |
| 130 | TGUUCCUCGGGCGCUGGCCTT | 354 | GGCCAGCGCCCGAGGAACAT |
| 131 | TAGUACCACUGUCAGUUCCTT | 355 | GGAACUGACAGUGGUACUAT |
| 132 | TUCUUGACCAAGUACCACUTT | 356 | AGUGGUACUUGGUCAAGAAT |
| 133 | TGAUCUUGACCAAGUACCATT | 357 | UGGUACUUGGUCAAGAUCAT |
| 134 | TCGAUCUUGACCAAGUACCTT | 358 | GGUACUUGGUCAAGAUCGAT |
| 135 | TGGCGAUCUUGACCAAGUATT | 359 | UACUUGGUCAAGAUCGCCAT |
| 136 | TUCGUGAAGGCGGUAGGAGTT | 360 | CUCCUACCGCCUUCACGAAT |
| 137 | TCCUCGUGAAGGCGGUAGGTT | 361 | CCUACCGCCUUCACGAGGAT |
| 138 | TCCCUCGUGAAGGCGGUAGTT | 362 | CUACCGCCUUCACGAGGGAT |
| 139 | TCGCAGAGCACUGUCUCAGTT | 363 | CUGAGACAGUGCUCUGCGAT |
| 140 | TCUUCAGCCCCCUCGAACUTT | 364 | AGUUCGAGGGGCUGAAGAT |
| 141 | TCUUCAGCCCCCUCGAACTT | 365 | GUUCGAGGGGCUGAAGAAT |
| 142 | TAUUCUUCAGCCCCCUCGATT | 366 | UCGAGGGGCUGAAGAAUAT |
| 143 | TCUCCGUGCACGUUAGAGTT | 367 | CUCUAACGUGCACGGAGAAT |
| 144 | TCGUCUCCGUGCACGUUAGTT | 368 | CUAACGUGCACGGAGACGAT |
| 145 | TUGGCGUCUCCGUGCACGUTT | 369 | ACGUGCACGGAGACGCCAAT |
| 146 | ACUUUCACUUUCUUGGGCUTT | 370 | UAUAGCCCAAGAAAGUGAAAGAT |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 147 | AGGUCUUUCACUUUCUUGGTT | 371 | AGCCCAAGAAAGUGAAAGUT |
| 148 | UGGUCUUUCACUUUCUUGGTT | 372 | UAUGCCCAAGAAAGUGAAAGAAT |
| 149 | UGGUCUUUCACUUUCUUGGGCUC | 373 | UAUCCCAAGAAAGUGAAAGACAT |
| 150 | TGGUCUUUCACUUUCUUGGGCUCAU | 374 | UAUCCAAGAAAGUGAAAGACCAT |
| 151 | TGGUCUUUCACUUUCUUGGGCUCUTT | 375 | CCAAGAAAGUGAAAGACCUT |
| 152 | TGGUCUUUCACUUUCUUGGGCUCU | 376 | UAUCAAGAAAGUGAAAGACCAAT |
| 153 | TGGUCUUUCACUUUCUUGGGCUC | 377 | UAUUUUGAGCCUCAGCUUCUCAT |
| 154 | TCUUUCACUUUCUUGGGCUCCAA | 378 | GCCCAAGAAAGUGAAAGACCAUAU |
| 155 | TUCUUUCACUUUCUUGGGCUCCA | 379 | UAUAUGCCCAAGAAAGUGAAAGACCA |
| 156 | TGUCUUUCACUUUCUUGGGCUCC | 380 | UGCCCAAGAAAGUGAAAGACCA |
| 157 | TUGGUCUUUCACUUUCUUGGGCU | 381 | GCCCAAGAAAGUGAAAGACCA |
| 158 | TGAGAAGCUGAGGCUCAAAGCAC | 382 | GGAGCCCAAGAAAGUGAAAGA |
| 159 | TGAGAAGCUGAGGCUCAAAGCACUAU | 383 | GAGCCCAAGAAAGUGAAAGAA |
| 160 | TGGUCUUUCACUUUCUUGGGCAUAUA | 384 | AGCCCAAGAAAGUGAAAGACA |
| 161 | TGGUCUUUCACUUUCUUGGGCUCAUAUA | 385 | CCCAAGAAAGUGAAAGACCAA |
| 162 | TGAGAAGCUGAGGCUCAAAGCAUAUA | 386 | GCUUUGAGCCUCAGCUUCUCA |
| 163 | TGAGAAGCUGAGGCUCAAAGCACAUAUA | 387 | UAUAUGCUUUGAGCCUCAGCUUCUCA |
| 164 | TGGUCUUUCACUUUCUUGGGCUCUA | 388 | UAUAUGAGCCCAAGAAAGUGAAAGACCA |
| 165 | TCACUUUCUUGGGCUCCAAACAGUAU | 389 | UAUAUGUGCUUUGAGCCUCAGCUUCUCA |
| 166 | TUCACUUUCUUGGGCUCCAAACAUAU | 390 | UAUAUGUUUGGAGCCCAAGAAAGUGA |
| 167 | TUUCACUUUCUUGGGCUCCAAACUAU | 391 | UAUAUUUUGGAGCCCAAGAAAGUGAA |
| 168 | TUUUCACUUUCUUGGGCUCCAAAUAU | 392 | UAUAUUUGGAGCCCAAGAAAGUGAAA |
| 169 | TAGCUGAGGCUCAAAGCACUUCUUAU | 393 | UAUAUUGGAGCCCAAGAAAGUGAAAA |
| 170 | TGAAGCUGAGGCUCAAAGCACUUUAU | 394 | UAUAUAAGUGCUUUGAGCCUCAGCUA |
| 171 | TUUGUUGCGGUCACCACAGCCCGUAU | 395 | UAUAUGUGCUUUGAGCCUCAGCUUCA |
| 172 | TGCUUGUUGCGGUCACCACAGCCUAU | 396 | UAUAUGGCUGUGGUGACCGCAACAAA |
| 173 | TGGCUUGUUGCGGUCACCACAGCUAU | 397 | UAUAUCUGUGGUGACCGCAACAAGCA |
| 174 | TGGUCUUUCACUUUCUUGG | 398 | UAUAUUGUGGUGACCGCAACAAGCCA |
| 175 | TGGUCUUUCACUUUCUUG | 399 | UAUUAGCCCAAGAAAGUGAAAGACCA |
| 176 | TGGUCUUUCACUUUCUU | 400 | UAUAAGCCCAAGAAAGUGAAAGACCA |
| 177 | UGGUCUUUCACUUUCUUGGGCUCUAU | 401 | AUAUUGCCCAAGAAAGUGAAAGACCA |
| 178 | UGAAGCUGAGGCUCAAAGCACUUUAU | 402 | CCAAGAAAGUGAAAGACCAUAU |
| 179 | UCACUUUCUUGGGCUCCA | 403 | UGGAGCCCAAGAAAGUGA |
| 180 | UUCACUUUCUUGGGCUCC | 404 | GGAGCCCAAGAAAGUGAA |
| 181 | UUUCACUUUCUUGGGCUC | 405 | GAGCCCAAGAAAGUGAAA |
| 182 | UUUUCACUUUCUUGGGCU | 406 | AGCCCAAGAAAGUGAAAA |
| 183 | UCUUUCACUUUCUUGGGC | 407 | GCCCAAGAAAGUGAAAGA |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 184 | UUCUUUCACUUUCUUGGG | 408 | CCCAAGAAAGUGAAAGAA |
| 185 | UGUCUUUCACUUUCUUGG | 409 | CCAAGAAAGUGAAAGACA |
| 186 | UGGUCUUUCACUUUCUUG | 410 | CAAGAAAGUGAAAGACCA |
| 187 | UUGGUCUUUCACUUUCUU | 411 | AAGAAAGUGAAAGACCAA |
| 188 | UAGCUGAGGCUCAAAGCA | 412 | UGCUUUGAGCCUCAGCUA |
| 189 | UGAAGCUGAGGCUCAAAG | 413 | CUUUGAGCCUCAGCUUCA |
| 190 | UGAGAAGCUGAGGCUCAA | 414 | UUGAGCCUCAGCUUCUCA |
| 191 | UUUGUUGCGGUCACCACA | 415 | UGUGGUGACCGCAACAAA |
| 192 | UCUUGUUGCGGUCACCAC | 416 | GUGGUGACCGCAACAAGA |
| 193 | UGCUUGUUGCGGUCACCA | 417 | UGGUGACCGCAACAAGCA |
| 194 | UGGCUUGUUGCGGUCACC | 418 | GGUGACCGCAACAAGCCA |
| 195 | UCACUUUCUUGGGCUCC | 419 | GGAGCCCAAGAAAGUGA |
| 196 | UUCACUUUCUUGGGCUC | 420 | GAGCCCAAGAAAGUGAA |
| 197 | UUUCACUUUCUUGGGCU | 421 | AGCCCAAGAAAGUGAAA |
| 198 | UUUUCACUUUCUUGGGC | 422 | GCCCAAGAAAGUGAAAA |
| 199 | UCUUUCACUUUCUUGGG | 423 | CCCAAGAAAGUGAAAGA |
| 200 | UUCUUUCACUUUCUUGG | 424 | CCAAGAAAGUGAAAGAA |
| 201 | UGUCUUUCACUUUCUUG | 425 | CAAGAAAGUGAAAGACA |
| 202 | UGGUCUUUCACUUUCUU | 426 | AAGAAAGUGAAAGACCA |
| 203 | UUGGUCUUUCACUUUCU | 427 | AGAAAGUGAAAGACCAA |
| 204 | UAGCUGAGGCUCAAAGC | 428 | GCUUUGAGCCUCAGCUA |
| 205 | UGAAGCUGAGGCUCAAA | 429 | UUUGAGCCUCAGCUUCA |
| 206 | UGAGAAGCUGAGGCUCA | 430 | UGAGCCUCAGCUUCUCA |
| 207 | UUUGUUGCGGUCACCAC | 431 | GUGGUGACCGCAACAAA |
| 208 | UCUUGUUGCGGUCACCA | 432 | UGGUGACCGCAACAAGA |
| 209 | UGCUUGUUGCGGUCACC | 433 | GGUGACCGCAACAAGCA |
| 210 | UGGCUUGUUGCGGUCAC | 434 | GUGACCGCAACAAGCCA |
| 211 | GGUCUUUCACUUUCUUGGGCUCUA | 435 | AUAUGCCCAAGAAAGUGAAAGACCA |
| 212 | GUCUUUCACUUUCUUGGGCUCUA | 436 | UAUGCCCAAGAAAGUGAAAGACCA |
| 213 | UCUUUCACUUUCUUGGGCUCUA | 437 | AUGCCCAAGAAAGUGAAAGACCA |
| 214 | GGUCUUUCACUUUCUUGGGCUCUAU | 438 | UAUAUGCCCAAGAAAGUGAAAGAUAU |
| 215 | GUCUUUCACUUUCUUGGGCUCUAU | 439 | UAUAUGCCCAAGAAAGUGAAAGACC |
| 216 | UGGUCUUUCACUUUCUUGGGCUCUAU | 440 | UAUGCCCAAGAAAGUGAAAGACCUAU |
| 217 | GGUCUUUCACUUUCUUGGGCUCU | 441 | UAUGCCCAAGAAAGUGAAAGACCAAU |
| 218 | TGGUCUUUCACUUUCUUGGGCU | 442 | UAUGCCCAAGAAAGUGAAAGACCAUU |
| 219 | GGUCUUUCACUUUCUUGGGCUC | 443 | UAUGCCCAAGAAAGUGAAAGACCAUA |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 220 | UAUGGUCUUUCACUUUCUUGGGCUCU | 444 | UUAGAGCCCAAGAAAGUGAAAGACCA |
| 221 | TGGUCUUUCACUUUCUUGGGC | 445 | UUAUUGCCCAAGAAAGUGAAAGACCA |
| 222 | UGGUCUUUCACUUUCUUGGGCUUCAU | 446 | UUGAUGCCCAAGAAAGUGAAAGACCA |
| 223 | UUAUGGUCUUUCACUUUCUUGGGCUC | 447 | UAUGAGCCCAAGAAAGUGAAAGACCA |
| 224 | UGAUGGUCUUUCACUUUCUUGGGCUC | 448 | AUAGAGCCCAAGAAAGUGAAAGACCA |
| 1307 | UGGUCUUUCACUUUCUUGGGCUAUAU | 449 | AUGCCCAAGAAAGUGAAAGACCUAUU |
| 1308 | UCUUUCACUUUCUUGGG | 450 | AUGCCCAAGAAAGUGAAAGACCUGAU |
| 1309 | ACUUUCACUUUCUUGGG | 1317 | AUAGAGCCCAAGAAAGUGAAAGACCA |
| 1310 | UGGUCUUUCACUUUCUUGGGCAUUAU | 1318 | CCCAAGAAAGUGAAAGU |
| 1311 | UGGUCUUUCACUUUCUUGGGCUCAUA | 1319 | GAGCCCAAGAAAGUGAAAGACCUAUU |
| 1312 | AGGUCUUUCACUUUCUUGGGCUCUAU | 1320 | GAGCCCAAGAAAGUGAAAGACCUGAU |
| 1313 | GGUCUUUCACUUUCUUGGGCUCUAU | 1321 | UAUAUGCCCAAGAAAGUGAAAGACCU |
| 1314 | UCGUCUUUCACUUUCUUGGGCUCUAU | | |
| 1315 | UAGUCUUUCACUUUCUUGGGCUCUAU | | |
| 1316 | UUGUCUUUCACUUUCUUGGGCUCUAU | | |
| 1407 | GGGUGGUAGCACACCAGGG | 1375 | CCCUGGUGUGCUACCACCC |
| 1408 | GGGGUGGUAGCACACCAGG | 1376 | CCUGGUGUGCUACCACCCC |
| 1409 | GGGGGUGGUAGCACACCAG | 1377 | CUGGUGUGCUACCACCCCC |
| 1410 | UCACUUUCUUGGGCUCCAA | 1378 | UUGGAGCCCAAGAAAGUGA |
| 1411 | UUCACUUUCUUGGGCUCCA | 1379 | UGGAGCCCAAGAAAGUGAA |
| 1412 | UUUCACUUUCUUGGGCUCC | 1380 | GGAGCCCAAGAAAGUGAAA |
| 1413 | CUUUCACUUUCUUGGGCUC | 1381 | GAGCCCAAGAAAGUGAAAG |
| 1414 | UCUUUCACUUUCUUGGGCU | 1382 | AGCCCAAGAAAGUGAAAGA |
| 1415 | GUCUUUCACUUUCUUGGGC | 1383 | GCCCAAGAAAGUGAAAGAC |
| 1416 | GGUCUUUCACUUUCUUGGG | 1384 | CCCAAGAAAGUGAAAGACC |
| 1417 | UGGUCUUUCACUUUCUUGG | 1385 | CCAAGAAAGUGAAAGACCA |
| 1418 | GUGGUCUUUCACUUUCUUG | 1386 | CAAGAAAGUGAAAGACCAC |
| 1419 | AAGCUGAGGCUCAAAGCAC | 1387 | GUGCUUUGAGCCUCAGCUU |
| 1420 | GAAGCUGAGGCUCAAAGCA | 1388 | UGCUUUGAGCCUCAGCUUC |
| 1421 | AGAAGCUGAGGCUCAAAGC | 1389 | GCUUUGAGCCUCAGCUUCU |
| 1422 | GGAGAAGCUGAGGCUCAAA | 1390 | UUUGAGCCUCAGCUUCUCC |
| 1423 | GGCAGGCCUGGCUGGCCAG | 1391 | CUGGCCAGCCAGGCCUGCC |
| 1424 | CGCCCCUCGAACUGGUGG | 1392 | CCACCAGUUCGAGGGGGCG |
| 1425 | GUUGCGGUCACCACAGCCC | 1393 | GGGCUGUGGUGACCGCAAC |
| 1426 | UGUUGCGGUCACCACAGCC | 1394 | GGCUGUGGUGACCGCAACA |
| 1427 | UUGUUGCGGUCACCACAGC | 1395 | GCUGUGGUGACCGCAACAA |
| 1428 | CUUGUUGCGGUCACCACAG | 1396 | CUGUGGUGACCGCAACAAG |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 1429 | GCUUGUUGCGGUCACCACA | 1397 | UGUGGUGACCGCAACAAGC |
| 1430 | GGCUUGUUGCGGUCACCAC | 1398 | GUGGUGACCGCAACAAGCC |
| 1431 | UGGCUUGUUGCGGUCACCA | 1399 | UGGUGACCGCAACAAGCCA |
| 1432 | AAAGCACUUUAUUGAGUUC | 1400 | GAACUCAAUAAAGUGCUUU |
| 1433 | CAAAGCACUUUAUUGAGUU | 1401 | AACUCAAUAAAGUGCUUUG |
| 1434 | UCAAAGCACUUUAUUGAGU | 1402 | ACUCAAUAAAGUGCUUUGA |
| 1435 | UUCAAAGCACUUUAUUGAG | 1403 | CUCAAUAAAGUGCUUUGAA |
| 1436 | UUUCAAAGCACUUUAUUGA | 1404 | UCAAUAAAGUGCUUUGAAA |
| 1437 | UUUUCAAAGCACUUUAUUG | 1405 | CAAUAAAGUGCUUUGAAAA |
| 1438 | AUUUUCAAAGCACUUUAUU | 1406 | AAUAAAGUGCUUUGAAAAU |
| 1463 | TGGUGGUAGCACACCAGGGTT | 1439 | CCCUGGUGUGCUACCACCAT |
| 1464 | TGGGUGGUAGCACACCAGGTT | 1440 | CCUGGUGUGCUACCACCCAT |
| 1465 | TGGGGUGGUAGCACACCAGTT | 1441 | CUGGUGUGCUACCACCCCAT |
| 1466 | TCACUUUCUUGGGCUCCAATT | 1442 | UUGGAGCCCAAGAAAGUGAT |
| 1467 | TUCACUUUCUUGGGCUCCATT | 1443 | UGGAGCCCAAGAAAGUGAAT |
| 1468 | TUUCACUUUCUUGGGCUCCTT | 1444 | GGAGCCCAAGAAAGUGAAAT |
| 1469 | TUUUCACUUUCUUGGGCUCTT | 1445 | GAGCCCAAGAAAGUGAAAAT |
| 1470 | TAGCUGAGGCUCAAAGCACTT | 1446 | GCCCAAGAAAGUGAAAGAAT |
| 1471 | TAAGCUGAGGCUCAAAGCATT | 1447 | GUGCUUUGAGCCUCAGCUAT |
| 1472 | TGAAGCUGAGGCUCAAAGCTT | 1448 | UGCUUUGAGCCUCAGCUUAT |
| 1473 | TGCAGGCCUGGCUGGCCAGTT | 1449 | GCUUUGAGCCUCAGCUUCAT |
| 1474 | TGCCCCCUCGAACUGGUGGTT | 1450 | CUGGCCAGCCAGGCCUGCAT |
| 1475 | TUUGCGGUCACCACAGCCCTT | 1451 | CCACCAGUUCGAGGGGGCAT |
| 1476 | TGUUGCGGUCACCACAGCCTT | 1452 | GGGCUGUGGUGACCGCAAAT |
| 1477 | TUGUUGCGGUCACCACAGCTT | 1453 | GGCUGUGGUGACCGCAACAT |
| 1478 | TUUGUUGCGGUCACCACAGTT | 1454 | GCUGUGGUGACCGCAACAAT |
| 1479 | TCUUGUUGCGGUCACCACATT | 1455 | CUGUGGUGACCGCAACAAAT |
| 1480 | TGCUUGUUGCGGUCACCACTT | 1456 | UGUGGUGACCGCAACAAGAT |
| 1481 | TGGCUUGUUGCGGUCACCATT | 1457 | GUGGUGACCGCAACAAGCAT |
| 1482 | TAAGCACUUUAUUGAGUUCTT | 1458 | UGGUGACCGCAACAAGCCAT |
| 1483 | TAAAGCACUUUAUUGAGUUTT | 1459 | GAACUCAAUAAAGUGCUUAT |
| 1484 | TCAAAGCACUUUAUUGAGUTT | 1460 | CUCAAUAAAGUGCUUUGAAT |
| 1485 | TUCAAAGCACUUUAUUGAGTT | 1461 | UCAAUAAAGUGCUUUGAAAT |
| 1486 | TUUCAAAGCACUUUAUUGATT | 1462 | CAAUAAAGUGCUUUGAAAAT |
| 1487 | TUUUCAAAGCACUUUAUUGTT | | |
| 1488 | TUUUUCAAAGCACUUUAUUTT | | |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 1602 | AUCGAAAGUGUUGACUCCA | 1489 | UGGAGUCAACACUUUCGAU |
| 1603 | AAUCGAAAGUGUUGACUCC | 1490 | GGAGUCAACACUUUCGAUU |
| 1604 | UGUACUUAUGCUCCUUGGG | 1491 | CCCAAGGAGCAUAAGUACA |
| 1605 | UUGUACUUAUGCUCCUUGG | 1492 | CCAAGGAGCAUAAGUACAA |
| 1606 | UUUGUACUUAUGCUCCUUG | 1493 | CAAGGAGCAUAAGUACAAA |
| 1607 | UCAGCUUUGUACUUAUGCU | 1494 | AGCAUAAGUACAAAGCUGA |
| 1608 | AACGACUGUGUGCUCUUCA | 1495 | UGAAGAGCACACAGUCGUU |
| 1609 | GAACGACUGUGUGCUCUUC | 1496 | GAAGAGCACACAGUCGUUC |
| 1610 | AGAACGACUGUGUGCUCUU | 1497 | AAGAGCACACAGUCGUUCU |
| 1611 | GACAGUGAGAACGACUGUG | 1498 | CACAGUCGUUCUCACUGUC |
| 1612 | GUGACAGUGAGAACGACUG | 1499 | CAGUCGUUCUCACUGUCAC |
| 1613 | GGUACAUUUGUGGUACAGC | 1500 | GCUGUACCACAAAUGUACC |
| 1614 | GGGUACAUUUGUGGUACAG | 1501 | CUGUACCACAAAUGUACCC |
| 1615 | UGGGUACAUUUGUGGUACA | 1502 | UGUACCACAAAUGUACCCA |
| 1616 | CUUGUGGGUACAUUUGUGG | 1503 | CCACAAAUGUACCCACAAG |
| 1617 | GACCCUUGCACUGGCAUCU | 1504 | AGAUGCCAGUGCAAGGGUC |
| 1618 | ACCUCUAGGCAGCGACCCC | 1505 | GGGGUCGCUGCCUAGAGGU |
| 1619 | CCGCGGCCAUCAUAGCAGC | 1506 | GCUGCUAUGAUGGCCGCGG |
| 1620 | CCCGCGGCCAUCAUAGCAG | 1507 | CUGCUAUGAUGGCCGCGGG |
| 1621 | GUAGCUGAGCCCGCGGCCA | 1508 | UGGCCGCGGGCUCAGCUAC |
| 1622 | GCGGUAGCUGAGCCCGCGG | 1509 | CCGCGGGCUCAGCUACCGC |
| 1623 | CGCACCCGAGAGCGUGGUC | 1510 | GACCACGCUCUCGGGUGCG |
| 1624 | GCGCACCCGAGAGCGUGGU | 1511 | ACCACGCUCUCGGGUGCGC |
| 1625 | GGCGCACCCGAGAGCGUGG | 1512 | CCACGCUCUCGGGUGCGCC |
| 1626 | AGUCCCAGUUCCGCGCUU | 1513 | AAGCGCGGAACUGGGGACU |
| 1627 | AGGCGUGGCCGCCCAGUCC | 1514 | GGACUGGGCGGCCACGCCU |
| 1628 | UCGUUGUCCGGGUUCCGGC | 1515 | GCCGGAACCCGGACAACGA |
| 1629 | UGUCGUUGUCCGGGUUCCG | 1516 | CGGAACCCGGACAACGACA |
| 1630 | AUGUCGUUGUCCGGGUUCC | 1517 | GGAACCCGGACAACGACAU |
| 1631 | GAUGUCGUUGUCCGGGUUC | 1518 | GAACCCGGACAACGACAUC |
| 1632 | GGCGGAUGUCGUUGUCCGG | 1519 | CCGGACAACGACAUCCGCC |
| 1633 | CACGGGCGGAUGUCGUUGU | 1520 | ACAACGACAUCCGCCCGUG |
| 1634 | CCACGGGCGGAUGUCGUUG | 1521 | CAACGACAUCCGCCCGUGG |
| 1635 | ACCACGGGCGGAUGUCGUU | 1522 | AACGACAUCCGCCCGUGGU |
| 1636 | CACCACGGGCGGAUGUCGU | 1523 | ACGACAUCCGCCCGUGGUG |
| 1637 | GAAGCACCACGGGCGGAUG | 1524 | CAUCCGCCCGUGGUGCUUC |
| 1638 | CGAAGCACCACGGGCGGAU | 1525 | AUCCGCCCGUGGUGCUUCG |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 1639 | CACGAAGCACCACGGGCGG | 1526 | CCGCCCGUGGUGCUUCGUG |
| 1640 | AGCACGAAGCACCACGGGC | 1527 | GCCCGUGGUGCUUCGUGCU |
| 1641 | GCAUGAGUGGGACAUGAAG | 1528 | CUUCAUGUCCCACUCAUGC |
| 1642 | CUUCGGCGGUGCCGGCUGC | 1529 | GCAGCCGGCACCGCCGAAG |
| 1643 | GACAGACUCUUGCGGAGCC | 1530 | GGCUCCGCAAGAGUCUGUC |
| 1644 | AGACAGACUCUUGCGGAGC | 1531 | GCUCCGCAAGAGUCUGUCU |
| 1645 | GGUCAUCGAAGACAGACUC | 1532 | GAGUCUGUCUUCGAUGACC |
| 1646 | GGGUCAUCGAAGACAGACU | 1533 | AGUCUGUCUUCGAUGACCC |
| 1647 | GACGCGGGUCAUCGAAGAC | 1534 | GUCUUCGAUGACCCGCGUC |
| 1648 | CGACGCGGGUCAUCGAAGA | 1535 | UCUUCGAUGACCCGCGUCG |
| 1649 | ACGACGCGGGUCAUCGAAG | 1536 | CUUCGAUGACCCGCGUCGU |
| 1650 | AACGACGCGGGUCAUCGAA | 1537 | UUCGAUGACCCGCGUCGUU |
| 1651 | CAACGACGCGGGUCAUCGA | 1538 | UCGAUGACCCGCGUCGUUG |
| 1652 | CCAACGACGCGGGUCAUCG | 1539 | CGAUGACCCGCGUCGUUGG |
| 1653 | GCCAACGACGCGGGUCAUC | 1540 | GAUGACCCGCGUCGUUGGC |
| 1654 | CCGCCAACGACGCGGGUCA | 1541 | UGACCCGCGUCGUUGGCGG |
| 1655 | CCCGCCAACGACGCGGGUC | 1542 | GACCCGCGUCGUUGGCGGG |
| 1656 | CCCGCGUAGCGCCACCAGC | 1543 | GCUGGUGGCGCUACGCGGG |
| 1657 | GCCCCGCGUAGCGCCACCA | 1544 | UGGUGGCGCUACGCGGGGC |
| 1658 | CGCCCCGCGUAGCGCCACC | 1545 | GGUGGCGCUACGCGGGGCG |
| 1659 | GCGCCCCGCGUAGCGCCAC | 1546 | GUGGCGCUACGCGGGGCGC |
| 1660 | GGGGUGCGCCCCGCGUAGC | 1547 | GCUACGCGGGGCGCACCCC |
| 1661 | GGCGAUGUAGGGGUGCGCC | 1548 | GGCGCACCCCUACAUCGCC |
| 1662 | GCGCGGCGAUGUAGGGGUG | 1549 | CACCCCUACAUCGCCGCGC |
| 1663 | CAGCGCGGCGAUGUAGGGG | 1550 | CCCCUACAUCGCCGCGCUG |
| 1664 | ACAGCGCGGCGAUGUAGGG | 1551 | CCCUACAUCGCCGCGCUGU |
| 1665 | UACAGCGCGGCGAUGUAGG | 1552 | CCUACAUCGCCGCGCUGUA |
| 1666 | GUACAGCGCGGCGAUGUAG | 1553 | CUACAUCGCCGCGCUGUAC |
| 1667 | AGUACAGCGCGGCGAUGUA | 1554 | UACAUCGCCGCGCUGUACU |
| 1668 | CCAGUACAGCGCGGCGAUG | 1555 | CAUCGCCGCGCUGUACUGG |
| 1669 | CCCCAGUACAGCGCGGCGA | 1556 | UCGCCGCGCUGUACUGGGG |
| 1670 | GAUGAGGCUGCCGGCGCAG | 1557 | CUGCGCCGGCAGCCUCAUC |
| 1671 | CCGUCAGAUCCUCGGGUGC | 1558 | GCACCCGAGGAUCUGACGG |
| 1672 | ACCGUCAGAUCCUCGGGUG | 1559 | CACCCGAGGAUCUGACGGU |
| 1673 | GCGAGAAGGCCUCGUGCAA | 1560 | UUGCACGAGGCCUUCUCGC |
| 1674 | GGCGAGAAGGCCUCGUGCA | 1561 | UGCACGAGGCCUUCUCGCC |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 1675 | CAACAGAGCCAGGUCGUGC | 1562 | GCACGACCUGGCUCUGUUG |
| 1676 | CCUGAAGGCGCAACAGAGC | 1563 | GCUCUGUUGCGCCUUCAGG |
| 1677 | CAUCCUCCUGAAGGCGCAA | 1564 | UUGCGCCUUCAGGAGGAUG |
| 1678 | GAGCGCGCAGCUGCCGUCC | 1565 | GGACGGCAGCUGCGCGCUC |
| 1679 | GUAAGGCGACAGGAGCGCG | 1566 | CGCGCUCCUGUCGCCUUAC |
| 1680 | CGUAAGGCGACAGGAGCGC | 1567 | GCGCUCCUGUCGCCUUACG |
| 1681 | ACGUAAGGCGACAGGAGCG | 1568 | CGCUCCUGUCGCCUUACGU |
| 1682 | AACGUAAGGCGACAGGAGC | 1569 | GCUCCUGUCGCCUUACGUU |
| 1683 | GAACGUAAGGCGACAGGAG | 1570 | CUCCUGUCGCCUUACGUUC |
| 1684 | UGAACGUAAGGCGACAGGA | 1571 | UCCUGUCGCCUUACGUUCA |
| 1685 | GGCUGAACGUAAGGCGACA | 1572 | UGUCGCCUUACGUUCAGCC |
| 1686 | CGGCUGAACGUAAGGCGAC | 1573 | GUCGCCUUACGUUCAGCCG |
| 1687 | CCGGCUGAACGUAAGGCGA | 1574 | UCGCCUUACGUUCAGCCGG |
| 1688 | ACCGGCUGAACGUAAGGCG | 1575 | CGCCUUACGUUCAGCCGGU |
| 1689 | CACCGGCUGAACGUAAGGC | 1576 | GCCUUACGUUCAGCCGGUG |
| 1690 | CACACCGGCUGAACGUAAG | 1577 | CUUACGUUCAGCCGGUGUG |
| 1691 | AGGCACACCGGCUGAACGU | 1578 | ACGUUCAGCCGGUGUGCCU |
| 1692 | GCCGCUUGGCAGGCACACC | 1579 | GGUGUGCCUGCCAAGCGGC |
| 1693 | GCCCCCUCGAACUGGUGGC | 1580 | GCCACCAGUUCGAGGGGGC |
| 1694 | CCGCCCCUCGAACUGGUG | 1581 | CACCAGUUCGAGGGGCGG |
| 1695 | UAUUCCUCCGCCCCCUCGA | 1582 | UCGAGGGGCGGAGGAAUA |
| 1696 | CUCGAGGAACCCUGCGCAG | 1583 | CUGCGCAGGGUUCCUCGAG |
| 1697 | CCUCGAGGAACCCUGCGCA | 1584 | UGCGCAGGGUUCCUCGAGG |
| 1698 | CCCUCGAGGAACCCUGCGC | 1585 | GCGCAGGGUUCCUCGAGGG |
| 1699 | CGGUGCCGCCCUCGAGGAA | 1586 | UUCCUCGAGGGCGGCACCG |
| 1700 | CAUCGGUGCCGCCCUCGAG | 1587 | CUCGAGGGCGGCACCGAUG |
| 1701 | GCAUCGGUGCCGCCCUCGA | 1588 | UCGAGGGCGGCACCGAUGC |
| 1702 | AGGGUGAGCCGGCGCUCUG | 1589 | CAGAGCGCCGGCUCACCCU |
| 1703 | AGCCCGAUCCCCAGCUGAU | 1590 | AUCAGCUGGGGAUCGGGCU |
| 1704 | CGGUCACCACAGCCCGAUC | 1591 | GAUCGGGCUGUGGUGACCG |
| 1705 | GACGCCUGGCUUGUUGCGG | 1592 | CCGCAACAAGCCAGGCGUC |
| 1706 | UAGACGCCUGGCUUGUUGC | 1593 | GCAACAAGCCAGGCGUCUA |
| 1707 | CACAUCGGUGUAGACGCCU | 1594 | AGGCGUCUACACCGAUGUG |
| 1708 | CCACAUCGGUGUAGACGCC | 1595 | GGCGUCUACACCGAUGUGG |
| 1709 | GCCACAUCGGUGUAGACGC | 1596 | GCGUCUACACCGAUGUGGC |
| 1710 | GGUGUGCUCCCGGAUCCAG | 1597 | CUGGAUCCGGGAGCACACC |
| 1711 | UGAGUCCCUGAGCAAUCAG | 1598 | CUGAUUGCUCAGGGACUCA |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 1712 | AGAUGAGUCCCUGAGCAAU | 1599 | AUUGCUCAGGGACUCAUCU |
| 1713 | AGCACUUUAUUGAGUUCCU | 1600 | AGGAACUCAAUAAAGUGCU |
| 1714 | AAGCACUUUAUUGAGUUCC | 1601 | GGAACUCAAUAAAGUGCUU |
| 1827 | TUCGAAAGUGUUGACUCCATT | 1715 | UGGAGUCAACACUUUCGAAT |
| 1828 | TAUCGAAAGUGUUGACUCCTT | 1716 | GGAGUCAACACUUUCGAUAT |
| 1829 | TGUACUUAUGCUCCUUGGGTT | 1717 | CCCAAGGAGCAUAAGUACAT |
| 1830 | TUGUACUUAUGCUCCUUGGTT | 1718 | CCAAGGAGCAUAAGUACAAT |
| 1831 | TUUGUACUUAUGCUCCUUGTT | 1719 | CAAGGAGCAUAAGUACAAAT |
| 1832 | TCAGCUUUGUACUUAUGCUTT | 1720 | AGCAUAAGUACAAAGCUGAT |
| 1833 | TACGACUGUGUGCUCUUCATT | 1721 | UGAAGAGCACACAGUCGUAT |
| 1834 | TAACGACUGUGUGCUCUUCTT | 1722 | GAAGAGCACACAGUCGUUAT |
| 1835 | TGAACGACUGUGUGCUCUUTT | 1723 | AAGAGCACACAGUCGUUCAT |
| 1836 | TACAGUGAGAACGACUGUGTT | 1724 | CACAGUCGUUCUCACUGUAT |
| 1837 | TUGACAGUGAGAACGACUGTT | 1725 | CAGUCGUUCUCACUGUCAAT |
| 1838 | TGUACAUUUGUGGUACAGCTT | 1726 | GCUGUACCACAAAUGUACAT |
| 1839 | TGGUACAUUUGUGGUACAGTT | 1727 | CUGUACCACAAAUGUACCAT |
| 1840 | TGGGUACAUUUGUGGUACATT | 1728 | UGUACCACAAAUGUACCCAT |
| 1841 | TUUGUGGGUACAUUUGUGGTT | 1729 | CCACAAAUGUACCCACAAAT |
| 1842 | TACCCUUGCACUGGCAUCUTT | 1730 | AGAUGCCAGUGCAAGGGUAT |
| 1843 | TCCUCUAGGCAGCGACCCCTT | 1731 | GGGGUCGCUGCCUAGAGGAT |
| 1844 | TCGCGGCCAUCAUAGCAGCTT | 1732 | GCUGCUAUGAUGGCCGCGAT |
| 1845 | TCCGCGGCCAUCAUAGCAGTT | 1733 | CUGCUAUGAUGGCCGCGGAT |
| 1846 | TUAGCUGAGCCCGCGGCCATT | 1734 | UGGCCGCGGGCUCAGCUAAT |
| 1847 | TCGGUAGCUGAGCCCGCGGTT | 1735 | CCGCGGGCUCAGCUACCGAT |
| 1848 | TGCACCCGAGAGCGUGGUCTT | 1736 | GACCACGCUCUCGGGUGCAT |
| 1849 | TCGCACCCGAGAGCGUGGUTT | 1737 | ACCACGCUCUCGGGUGCGAT |
| 1850 | TGCGCACCCGAGAGCGUGGTT | 1738 | CCACGCUCUCGGGUGCGCAT |
| 1851 | TGUCCCCAGUUCCGCGCUUTT | 1739 | GGACUGGGCGGCCACGCCAT |
| 1852 | TGGCGUGGCCGCCCAGUCCTT | 1740 | GCCGGAACCCGGACAACGAT |
| 1853 | TCGUUGUCCGGGUUCCGGCTT | 1741 | CGGAACCCGGACAACGACAT |
| 1854 | TGUCGUUGUCCGGGUUCCGTT | 1742 | GGAACCCGGACAACGACAAT |
| 1855 | TUGUCGUUGUCCGGGUUCCTT | 1743 | GAACCCGGACAACGACAUAT |
| 1856 | TAUGUCGUUGUCCGGGUUCTT | 1744 | CCGGACAACGACAUCCGCAT |
| 1857 | TGCGGAUGUCGUUGUCCGGTT | 1745 | ACAACGACAUCCGCCCGUAT |
| 1858 | TACGGGCGGAUGUCGUUGUTT | 1746 | CAACGACAUCCGCCCGUGAT |
| 1859 | TCACGGGCGGAUGUCGUUGTT | 1747 | AACGACAUCCGCCCGUGGAT |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 1860 | TCCACGGGCGGAUGUCGUUTT | 1748 | ACGACAUCCGCCCGUGGUAT |
| 1861 | TACCACGGGCGGAUGUCGUTT | 1749 | CAUCCGCCCGUGGUGCUUAT |
| 1862 | TAAGCACCACGGGCGGAUGTT | 1750 | AUCCGCCCGUGGUGCUUCAT |
| 1863 | TGAAGCACCACGGGCGGAUTT | 1751 | CCGCCCGUGGUGCUUCGUAT |
| 1864 | TACGAAGCACCACGGGCGGTT | 1752 | GCCCGUGGUGCUUCGUGCAT |
| 1865 | TGCACGAAGCACCACGGGCTT | 1753 | CUUCAUGUCCCACUCAUGAT |
| 1866 | TCAUGAGUGGGACAUGAAGTT | 1754 | GCAGCCGGCACCGCCGAAAT |
| 1867 | TUUCGGCGGUGCCGGCUGCTT | 1755 | GGCUCCGCAAGAGUCUGUAT |
| 1868 | TACAGACUCUUGCGGAGCCTT | 1756 | GCUCCGCAAGAGUCUGUCAT |
| 1869 | TGACAGACUCUUGCGGAGCTT | 1757 | GAGUCUGUCUUCGAUGACAT |
| 1870 | TGUCAUCGAAGACAGACUCTT | 1758 | AGUCUGUCUUCGAUGACCAT |
| 1871 | TGGUCAUCGAAGACAGACUTT | 1759 | GUCUUCGAUGACCCGCGUAT |
| 1872 | TACGCGGGUCAUCGAAGACTT | 1760 | UCUUCGAUGACCCGCGUCAT |
| 1873 | TGACGCGGGUCAUCGAAGATT | 1761 | CUUCGAUGACCCGCGUCGAT |
| 1874 | TCGACGCGGGUCAUCGAAGTT | 1762 | UUCGAUGACCCGCGUCGUAT |
| 1875 | TACGACGCGGGUCAUCGAATT | 1763 | UCGAUGACCCGCGUCGUUAT |
| 1876 | TAACGACGCGGGUCAUCGATT | 1764 | CGAUGACCCGCGUCGUUGAT |
| 1877 | TCAACGACGCGGGUCAUCGTT | 1765 | GAUGACCCGCGUCGUUGGAT |
| 1878 | TCCAACGACGCGGGUCAUCTT | 1766 | UGACCCGCGUCGUUGGCGAT |
| 1879 | TCGCCAACGACGCGGGUCATT | 1767 | GACCCGCGUCGUUGGCGGAT |
| 1880 | TCCGCCAACGACGCGGGUCTT | 1768 | GCUGGUGGCGCUACGCGGAT |
| 1881 | TCCGCGUAGCGCCACCAGCTT | 1769 | UGGUGGCGCUACGCGGGGAT |
| 1882 | TCCCCGCGUAGCGCCACCATT | 1770 | GGUGGCGCUACGCGGGGCAT |
| 1883 | TGCCCCGCGUAGCGCCACCTT | 1771 | GUGGCGCUACGCGGGGCGAT |
| 1884 | TCGCCCCGCGUAGCGCCACTT | 1772 | GCUACGCGGGGCGCACCCAT |
| 1885 | TGGGUGCGCCCCGCGUAGCTT | 1773 | GGCGCACCCCUACAUCGCAT |
| 1886 | TGCGAUGUAGGGGUGCGCCTT | 1774 | CACCCCUACAUCGCCGCGAT |
| 1887 | TCGCGGCGAUGUAGGGGUGTT | 1775 | CCCCUACAUCGCCGCGCUAT |
| 1888 | TAGCGCGGCGAUGUAGGGGTT | 1776 | CCCUACAUCGCCGCGCUGAT |
| 1889 | TCAGCGCGGCGAUGUAGGGTT | 1777 | CCUACAUCGCCGCGCUGUAT |
| 1890 | TACAGCGCGGCGAUGUAGGTT | 1778 | CUACAUCGCCGCGCUGUAAT |
| 1891 | TUACAGCGCGGCGAUGUAGTT | 1779 | UACAUCGCCGCGCUGUACAT |
| 1892 | TGUACAGCGCGGCGAUGUATT | 1780 | CAUCGCCGCGCUGUACUGAT |
| 1893 | TCAGUACAGCGCGGCGAUGTT | 1781 | UCGCCGCGCUGUACUGGGAT |
| 1894 | TCCCAGUACAGCGCGGCGATT | 1782 | CUGCGCCGGCAGCCUCAUAT |
| 1895 | TAUGAGGCUGCCGGCGCAGTT | 1783 | GCACCCGAGGAUCUGACGAT |
| 1896 | TCGUCAGAUCCUCGGGUGCTT | 1784 | CACCCGAGGAUCUGACGGAT |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 1897 | TCCGUCAGAUCCUCGGGUGTT | 1785 | UUGCACGAGGCCUUCUCGAT |
| 1898 | TCGAGAAGGCCUCGUGCAATT | 1786 | UGCACGAGGCCUUCUCGCAT |
| 1899 | TGCGAGAAGGCCUCGUGCATT | 1787 | GCACGACCUGGCUCUGUUAT |
| 1900 | TAACAGAGCCAGGUCGUGCTT | 1788 | GCUCUGUUGCGCCUUCAGAT |
| 1901 | TCUGAAGGCGCAACAGAGCTT | 1789 | UUGCGCCUUCAGGAGGAUAT |
| 1902 | TAUCCUCCUGAAGGCGCAATT | 1790 | GGACGGCAGCUGCGCGCUAT |
| 1903 | TAGCGCGCAGCUGCCGUCCTT | 1791 | CGCGCUCCUGUCGCCUUAAT |
| 1904 | TUAAGGCGACAGGAGCGCGTT | 1792 | GCGCUCCUGUCGCCUUACAT |
| 1905 | TGUAAGGCGACAGGAGCGCTT | 1793 | CGCUCCUGUCGCCUUACGAT |
| 1906 | TCGUAAGGCGACAGGAGCGTT | 1794 | GCUCCUGUCGCCUUACGUAT |
| 1907 | TACGUAAGGCGACAGGAGCTT | 1795 | CUCCUGUCGCCUUACGUUAT |
| 1908 | TAACGUAAGGCGACAGGAGTT | 1796 | UCCUGUCGCCUUACGUUCAT |
| 1909 | TGAACGUAAGGCGACAGGATT | 1797 | UGUCGCCUUACGUUCAGCAT |
| 1910 | TGCUGAACGUAAGGCGACATT | 1798 | GUCGCCUUACGUUCAGCCAT |
| 1911 | TGGCUGAACGUAAGGCGACTT | 1799 | UCGCCUUACGUUCAGCCGAT |
| 1912 | TCGGCUGAACGUAAGGCGATT | 1800 | CGCCUUACGUUCAGCCGGAT |
| 1913 | TCCGGCUGAACGUAAGGCGTT | 1801 | GCCUUACGUUCAGCCGGUAT |
| 1914 | TACCGGCUGAACGUAAGGCTT | 1802 | CUUACGUUCAGCCGGUGUAT |
| 1915 | TACACCGGCUGAACGUAAGTT | 1803 | ACGUUCAGCCGGUGUGCCAT |
| 1916 | TGGCACACCGGCUGAACGUTT | 1804 | GGUGUGCCUGCCAAGCGGAT |
| 1917 | TCCGCUUGGCAGGCACACCTT | 1805 | GCCACCAGUUCGAGGGGGAT |
| 1918 | TCCCCCUCGAACUGGUGGCTT | 1806 | CACCAGUUCGAGGGGGCGAT |
| 1919 | TCGCCCCCUCGAACUGGUGTT | 1807 | UCGAGGGGCGGAGGAAUAT |
| 1920 | TAUUCCUCCGCCCCCUCGATT | 1808 | CUGCGCAGGGUUCCUCGAAT |
| 1921 | TUCGAGGAACCCUGCGCAGTT | 1809 | UGCGCAGGGUUCCUCGAGAT |
| 1922 | TCUCGAGGAACCCUGCGCATT | 1810 | GCGCAGGGUUCCUCGAGGAT |
| 1923 | TCCUCGAGGAACCCUGCGCTT | 1811 | UUCCUCGAGGGCGGCACCAT |
| 1924 | TGGUGCCGCCCUCGAGGAATT | 1812 | CUCGAGGGCGGCACCGAUAT |
| 1925 | TAUCGGUGCCGCCCUCGAGTT | 1813 | UCGAGGGCGGCACCGAUGAT |
| 1926 | TCAUCGGUGCCGCCCUCGATT | 1814 | CAGAGCGCCGGCUCACCCAT |
| 1927 | TGGGUGAGCCGGCGCUCUGTT | 1815 | AUCAGCUGGGGAUCGGGCAT |
| 1928 | TGCCCGAUCCCCAGCUGAUTT | 1816 | GAUCGGGCUGUGGUGACCAT |
| 1929 | TGGUCACCACAGCCCGAUCTT | 1817 | CCGCAACAAGCCAGGCGUAT |
| 1930 | TACGCCUGGCUUGUUGCGGTT | 1818 | GCAACAAGCCAGGCGUCUAT |
| 1931 | TAGACGCCUGGCUUGUUGCTT | 1819 | AGGCGUCUACACCGAUGUAT |
| 1932 | TACAUCGGUGUAGACGCCUTT | 1820 | GGCGUCUACACCGAUGUGAT |

TABLE 1-continued

Unmodified F12 RNAi trigger antisense strand and sense strand sequences.

| SEQ ID No. | Antisense Sequence (5' → 3') | SEQ ID No. | Sense Sequence (5' → 3') |
|---|---|---|---|
| 1933 | TCACAUCGGUGUAGACGCCTT | 1821 | GCGUCUACACCGAUGUGGAT |
| 1934 | TCCACAUCGGUGUAGACGCTT | 1822 | CUGGAUCCGGGAGCACACAT |
| 1935 | TGUGUGCUCCCGGAUCCAGTT | 1823 | CUGAUUGCUCAGGGACUCAT |
| 1936 | TGAGUCCCUGAGCAAUCAGTT | 1824 | AUUGCUCAGGGACUCAUCAT |
| 1937 | TGAUGAGUCCCUGAGCAAUTT | 1825 | AGGAACUCAAUAAAGUGCAT |
| 1938 | TGCACUUUAUUGAGUUCCUTT | 1826 | GGAACUCAAUAAAGUGCUAT |
| 1939 | TAGCACUUUAUUGAGUUCCTT | | |
| 2172 | GGUCUUUCACUUUCUUGGGCUC | 2166 | GCCCAAGAAAGUGAAAGACC |
| 2173 | GAGAAGCUGAGGCUCAAAGCAC | 2167 | GCUUUGAGCCUCAGCUUCUC |
| 2174 | GUCUUUCACUUUCUUGGGCUCC | 2168 | AGCCCAAGAAAGUGAAAGAC |
| 2175 | CUUUCACUUUCUUGGGCUCCAA | 2169 | GGAGCCCAAGAAAGUGAAAG |
| 2176 | UCUUUCACUUUCUUGGGCUCCA | 2170 | GAGCCCAAGAAAGUGAAAGA |
| 2177 | UGGUCUUUCACUUUCUUGGGCU | 2171 | CCCAAGAAAGUGAAAGACCA |
| 2178 | UGGUCUUUCACUUUCUUGGGCUCAGU | 2183 | GACAUGCCCAAGAAAGUGAAAGACCA |
| 2179 | UGGUCUUUCACUUUCUUGGGCUCCAA | 2184 | GCGAUGCCCAAGAAAGUGAAAGACCA |
| 2180 | UGGUCUUUCACUUUCUUGGGCUCCAG | 2185 | UGAAUGCCCAAGAAAGUGAAAGACCA |
| 2181 | UGGUCUUUCACUUUCUUGGGCUCGCG | 2186 | UUGGAGCCCAAGAAAGUGAAAGACCA |
| 2182 | UGGUCUUUCACUUUCUUGGGCUCUAT | | |

The F12 RNAi triggers described herein are formed by annealing an antisense strand with a sense strand. In some embodiments, an F12 RNAi trigger antisense strand comprises a nucleotide sequence of any of the sequences in Tables 1 and 2. In some embodiments, an F12 RNAi trigger antisense strand comprises the sequence of nucleotides 1-17, 2-17, 1-18, 2-18, 1-19, 2-19, 1-20, 2-20, 1-21, 2-21, 1-22, 2-22, 1-23, 2-23, 1-24, 2-24, 1-25, 2-25, 1-26, or 2-26 of any of the sequences in Tables 1 and 2. In some embodiments, an F12 RNAi trigger sense strand comprises the nucleotide sequence of any of the sequences in Tables 1 and 3. In some embodiments, an F12 RNAi trigger sense strand comprises the sequence of nucleotides 1-17, 2-17, 1-18, 2-18, 1-19, 2-19, 1-20, 2-20, 1-21, 2-21, 1-22, 2-22, 1-23, 2-23, 1-24, 2-24, 1-25, 2-25, 1-26, or 2-26 of any of the sequences in Tables 1 and 3.

In some embodiments, the sense and antisense strands of the RNAi triggers described herein contain the same number of nucleotides. In some embodiments the sense and antisense strands of the RNAi triggers described herein contain different numbers of nucleotides. In some embodiments, the sense strand 5' end and the antisense strand 3' end of a herein described RNAi trigger form a blunt end. In some embodiments, the sense strand 3' end and the antisense strand 5' end of a herein described RNAi trigger form a blunt end. In some embodiments, both ends of a herein described RNAi trigger form a blunt end. In some embodiments, neither end of a herein described RNAi trigger is blunt-ended. As used herein a blunt end refers to an end of a double stranded trigger molecule in which the terminal nucleotides of the two annealed strands are complementary (form a complementary base-pair). In some embodiments, the sense strand 5' end and the antisense strand 3' end of a herein described RNAi trigger form a frayed end. In some embodiments, the sense strand 3' end and the antisense strand 5' end of a herein described RNAi trigger form a frayed end. In some embodiments, both ends of a herein described RNAi trigger form a frayed end. In some embodiments, neither end of a herein described RNAi trigger is a frayed end. As used herein a frayed end refers to an end of a double stranded trigger molecule in which the terminal nucleotides of the two annealed strands from a pair (i.e. do not form an overhang) but are not complementary (i.e. form a non-complementary pair). As used herein, an overhang is a stretch of one or more unpaired nucleotides at the end of one strand of a double stranded RNAi trigger molecule. The unpaired nucleotides may be on the sense strand or the antisense strand, creating either 3' or 5' overhangs. In some embodiments the RNAi trigger molecule contains: a blunt end and a frayed end, a blunt end and 5' overhang end, a blunt end and a 3' overhang end, a frayed end and a 5' overhand end, a frayed end and a 3' overhang end, two 5' overhang ends, two 3' overhang ends, a 5' overhang end and a 3' overhand end, two frayed ends, or two blunt ends.

In some embodiments, an F12 RNAi trigger contains one or more modified nucleotides. A nucleotide base (or nucleobase) is a heterocyclic pyrimidine or purine compound which is a constituent of all nucleic acids and includes adenine (A), guanine (G), cytosine (C), thymine (T), and uracil (U). As used herein, "G", "g", "C", "c", "A", "a", "U", "u", and "T", each generally stand for a nucleobase, nucleoside, nucleotide or nucleotide mimic that contains guanine, cytosine, adenine, uracil and thymidine as a base, respectively. Also as used herein, the term "nucleotide" can include a modified nucleotide or nucleotide mimic, abasic site, or a surrogate replacement moiety. As used herein, a "modified nucleotide" is a nucleotide, deoxynucleotide, nucleotide mimic, abasic site, or a surrogate replacement moiety other than a ribonucleotide (2'-hydroxyl nucleotide). In some embodiments, a modified nucleotide comprises a 2'-modified nucleotide (i.e. a nucleotide with a group other than a hydroxyl group at the 2' position of the five-membered sugar ring). Modified nucleotides include, but are not limited to: 2'-modified nucleotides, 2'-O-methyl nucleotides (represented herein as a lower case letter 'n' in a nucleotide sequence), 2'-deoxy-2'-fluoro nucleotides (represented herein as Nf, also represented herein as 2'-fluoro nucleotide), 2'-deoxy nucleotides (represented herein as dN), 2'-methoxyethyl (2'-O-2-methoxyethyl) nucleotides (represented herein as NM or 2'-MOE), 2'-amino nucleotides, 2'-alkyl nucleotides, 3' to 3' linkages (inverted) nucleotides (represented herein as invdN, invN, invn, invX), non-natural base comprising nucleotides, bridged nucleotides, peptide nucleic acids, 2',3'-seco nucleotide mimics (unlocked nucleobase analogues, represented herein as NUNA or NUNA), locked nucleotides (represented herein as NLNA or NLNA), 3'-O-Methoxy (2' internucleotide linked) nucleotide (represented herein as 3'-OMen), 2'-F-Arabino nucleotides (represented herein as NfANA or NfANA), morpholino nucleotides, vinyl phosphonate deoxyribonucleotide (represented herein as vpdN), vinyl phosphonate nucleotides, and abasic nucleotides (represented herein as X or Ab). It is not necessary for all positions in a given compound to be uniformly modified. Conversely, more than one modification may be incorporated in a single F12 RNAi trigger or even in a single nucleotide thereof. The F12 RNAi trigger sense strands and antisense strands may be synthesized and/or modified by methods known in the art. Modification at one nucleotide is independent of modification of another nucleotide.

Modified nucleobases include synthetic and natural nucleobases, such as 5-substituted pyrimidines, 6-azapyrimidines and N-2, N-6 and O-6 substituted purines, including 2-aminopropyladenine, 5-propynyluracil and 5-propynylcytosine, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. In some embodiments 20% or fewer of the modified nucleotides are 2'-fluoro modified nucleotides.

In some embodiments, an F12 RNAi trigger sense strand contains a 2'-F nucleotide at position 11 from the 3' end. In some embodiments, an F12 RNAi trigger sense strand contains a 2'-F nucleotide at position 12 from the 3' end. In some embodiments, an F12 RNAi trigger sense strand contains a 2'-F nucleotide at position 13 from the 3' end. In some embodiments, an F12 RNAi trigger sense strand contains at least two 2'-F nucleotides at positions 11, 12, and 13 from the 3' end. In some embodiments, an F12 RNAi trigger sense strand contains 2'-F nucleotides at positions 11 and 12, positions 11 and 13, or positions 12 and 13 from the 3' end. In some embodiments, an F12 RNAi trigger sense strand contains 2'-F nucleotides at positions 11, 12, and 13 from the 3' end.

In some embodiments, an F12 RNAi trigger antisense strand contains a 2'-F nucleotide at position 2 from the 5' end. In some embodiments, an F12 RNAi trigger antisense strand contains a 2'-F nucleotide at position 14 from the 5' end. In some embodiments, an F12 RNAi trigger antisense strand contains 2'-F nucleotides at positions 2 and 14 from the 5' end. In some embodiments, an F12 RNAi trigger contains at least two 2'-F nucleotides at positions 11, 12, and 13 from the 3' end of the sense strand and at positions 2 and 14 from the 5' end of the antisense strand.

In some embodiments, an F12 RNAi trigger antisense strand contains a 2'-F nucleotide at position 4 from the 5' end. In some embodiments, an F12 RNAi trigger antisense strand contains a 2'-F nucleotide at position 6 from the 5' end. In some embodiments, an F12 RNAi trigger antisense strand contains a 2'-F nucleotide at position 8 from the 5' end. In some embodiments, an F12 RNAi trigger antisense strand contains a 2'-F nucleotide at position 10 from the 5' end. In some embodiments, an F12 RNAi trigger antisense strand contains a 2'-F nucleotide at position 12 from the 5' end. In some embodiments, an F12 RNAi trigger antisense strand contains at least two 2'-F nucleotides at positions 4, 6, 8, 10, and 12 from the 5' end. In some embodiments, an F12 RNAi trigger antisense strand contains 2'-F nucleotides at positions 4 and 6, positions 4 and 8, positions 4 and 10, positions 4 and 12, positions 6 and 8, positions 6 and 10, positions 6 and 12, positions 8 and 10, positions 8 and 12, or positions 10 and 12 from the 5' end. In some embodiments, an F12 RNAi trigger antisense strand contains at three 2'-F nucleotides at positions 4, 6, 8, 10, and 12 from the 5' end. In some embodiments, an F12 RNAi trigger antisense strand contains at least four 2'-F nucleotides at positions 4, 6, 8, 10, and 12 from the 5' end. In some embodiments, an F12 RNAi trigger antisense strand contains 2'-F nucleotides at positions 4, 6, 8, and 10, positions 4, 6, 8, and 12, positions 4, 6, 10, and 12, positions 4, 8, 10, and 12 or positions 6, 8, 10, and 12 from the 5' end.

In some embodiments, an F12 RNAi trigger antisense strand contains a 2'-F nucleotide at position 2 and/or position 14 and one, two, or three 2'-F nucleotides at positions 11, 12, and 13 from the 5' end. In some embodiments, an F12 RNAi trigger contains a 2'-F nucleotide at position 2 and/or position 14 and one, two, or three 2'-F nucleotides at positions 11, 12, and 13 from the 5' end of the antisense strand, and at least two 2'-F nucleotides at positions 11, 12, and 13 from the 3' end of the sense strand.

In some embodiments, one or more nucleotides of an F12 RNAi trigger are linked by non-phosphate-containing covalent internucleoside linkages. Modified internucleoside linkages or backbones include, for example, phosphorothioates, 5'-phosphorothioate group (represented herein as a lower case 's' before a nucleotide, as in sN, sn, sNf, or sdN), chiral phosphorothioates, thiophosphate, phosphorodithioates, phosphotriesters, aminoalkyl-phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free-acid forms are also included. In some embodiments, a 2' modification may be combined with modified internucleoside linkages.

Modified internucleoside linkages or backbones can lack a phosphorus atom therein (e.g., oligonucleosides), which can be formed by short chain alkyl or cycloalkyl inter-sugar linkages, mixed heteroatom and alkyl or cycloalkyl inter-sugar linkages, or one or more short chain heteroatomic or heterocyclic inter-sugar linkages. Such modified linkages or backbones include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and CH$_2$ component parts.

In some embodiments, an F12 RNAi trigger can contain a modified backbone, i.e. the F12 RNAi trigger contains a non-standard linkage between two nucleotides. In some embodiments, the modified backbone one or more phosphorothioate linkages. For example, in some embodiments, a sense strand of an F12 RNAi trigger can contain 1, 2, 3, or 4 phosphorothioate linkages, an antisense strand of a F12 RNAi trigger can contain 1, 2, 3, or 4 phosphorothioate linkages, or both the sense strand and the antisense strand independently can contain 1, 2, 3, or 4 phosphorothioate linkages.

In some embodiments, an F12 RNAi trigger sense strand contains two phosphorothioate internucleotide linkages. In some embodiments, the two phosphorothioate internucleotide linkages are between the nucleotides at positions 1-3 from the 3' end of the sense strand. In some embodiments, the two phosphorothioate internucleotide linkages are between the nucleotides at positions 1-3, 2-4, 3-5, 4-6, 4-5, or 6-8 from the 5' end of the sense strand. In some embodiments, an F12 RNAi trigger antisense strand contains four phosphorothioate internucleotide linkages. In some embodiments, the four phosphorothioate internucleotide linkages are between the nucleotides at positions 1-3 from the 5' end of the sense strand and between the nucleotides at positions 19-21, 20-22, 21-23, 22-24, 23-25, or 24-26 from the 5' end. In some embodiments, an F12 RNAi trigger contains two phosphorothioate internucleotide linkages in the sense strand and four phosphorothioate internucleotide linkages in the antisense strand.

Examples of antisense strands containing modified nucleotides are provided in Table 2.

Examples of sense strands containing modified nucleotides are provided in Table 3. In Tables 2 and 3, the following notations are used to indicate modified nucleotides, targeting groups and linking groups:

N=2'-OH (unmodified) ribonucleotide (capital letter without for d indication)
n=2'-OMe modified nucleotide
Nf=2'-fluoro modified nucleotide
dN=2'-deoxy nucleotides
NUNA=2',3'-seco nucleotide mimics (unlocked nucleobase analogs)
NLNA=locked nucleotide
NfANA=2'-F-Arabino nucleotide
NM=2'-methoxyethyl nucleotide
X=abasic ribose
R=ribitol
(invdN)=inverted deoxyribonucleotide (3'-3' linked nucleotide)
(invX)=inverted abasic nucleotide
(invn)=inverted 2'-OMe nucleotide
s=phosphorothioate linked nucleotide
p=phosphate
vpdN=vinyl phosphonate deoxyribonucleotide
(3'OMen)=3'-OMe nucleotide The following targeting groups and linking groups are listed in Tables 2 and 3 and their chemical structures are provided further below in Table 4: (NAG3), (C6-NAG3), (C6-PEG4-NAG3), (C6-C6-NAG3), (C6-C12-NAG3), (C11-NAG3), (C11-palm-NAG3), (C11-PEG3-NAG3), (NAG4), (NAG13), (NAG14), (NAG15), (NAG16), (NAG17), (NAG18), (NAG19), (NAG20), (NAG21), (NAG23), (Chol-TEG), (TEG-Chol), (Alk-C6), (Alk-BC9-C6), (Alk-C6-C6), (C6-C6-Alk), (Alk-C6-Ser), (Ser-C6-Alk), (Alk-NHCO-C6), (Alk-NHCO—SS-C6), (Alk-PEG4-C6), (Alk-PEG5-C6), (C6-PEG5-Alk), (Alk-PEG13-C6), (Alk-PEG5-Ser), (Alk-PEG13-Ser), (Alk-SS-C6), (C6-SS-Alk-Me), (Me-Alk-SS-C6), (C6-SMPT-Alk), (BCN), (DBCO-TEG), (C6-NH2), (NH2-C6), (NH2-C7), (NH2-Ser), (C3), (C12), (C6-SS-C6), (Cy5-C6), (Norbomene-C6), (Norbomene-Ser), (PAZ), (Ser-NH2), (Sp9), (Sp18), (Spermiine), (Stearyl), (TetZ-C6) (NAG=N-Acetyl-galactosamine).

TABLE 2

Modified F12 RNAi trigger antisense strand sequences.

| Strand ID | SEQ ID No. | Antisense Sequence (5' → 3') |
|---|---|---|
| AM00978-AS | 451 | dTGfgUfgGfuAfgCfaCfaCfcAfgGfgdTsdT |
| AM00979-AS | 452 | dTGfgGfuGfgUfaGfcAfcAfcCfaGfgdTsdT |
| AM00980-AS | 453 | dTGfgGfgUfgGfuAfgCfaCfaCfcAfgdTsdT |
| AM00981-AS | 454 | dTCfaCfuUfuCfuUfgGfgCfuCfcAfadTsdT |
| AM00982-AS | 455 | dTUfcAfcUfuUfcUfuGfgGfcUfcCfadTsdT |
| AM00983-AS | 456 | dTUfuCfaCfuUfuCfuUfgGfgCfuCfcdTsdT |
| AM00984-AS | 457 | dTUfuUfcAfcUfuUfcUfuGfgGfcUfcdTsdT |

TABLE 2-continued

Modified F12 RNAi trigger antisense strand sequences.

| Strand ID | SEQ ID NO. | Antisense Sequence (5' → 3') |
|---|---|---|
| AM00985-AS | 458 | dTCfuUfuCfaCfuUfuCfuUfgGfgCfudTsdT |
| AM00986-AS | 459 | dTUfcUfuUfcAfcUfuUfcUfuGfgGfcdTsdT |
| AM00987-AS | 460 | dTGfuCfuUfuCfaCfuUfuCfuUfgGfgdTsdT |
| AM00988-AS | 461 | dTGfgUfcUfuUfcAfcUfuUfcUfuGfgdTsdT |
| AM00989-AS | 462 | dTUfgGfuCfuUfuCfaCfuUfuCfuUfgdTsdT |
| AM00990-AS | 463 | dTAfgCfuGfaGfgCfuCfaAfaGfcAfcdTsdT |
| AM00991-AS | 464 | dTAfaGfcUfgAfgGfcUfcAfaAfgCfadTsdT |
| AM00992-AS | 465 | dTGfaAfgCfuGfaGfgCfuCfaAfaGfcdTsdT |
| AM00993-AS | 466 | dTGfaGfaAfgCfuGfaGfgCfuCfaAfadTsdT |
| AM00994-AS | 467 | dTGfcAfgGfcCfuGfgCfuGfgCfcAfgdTsdT |
| AM00995-AS | 468 | dTGfcCfcCfcUfcGfaAfcUfgGfuGfgdTsdT |
| AM00996-AS | 469 | dTUfuGfcGfgUfcAfcCfaCfaGfcCfcdTsdT |
| AM00997-AS | 470 | dTGfuUfgCfgGfuCfaCfcAfcAfgCfcdTsdT |
| AM00998-AS | 471 | dTUfgUfuGfcGfgUfcAfcCfaCfaGfcdTsdT |
| AM00999-AS | 472 | dTUfuGfuUfgCfgGfuCfaCfcAfcAfgdTsdT |
| AM01000-AS | 473 | dTCfuUfgUfuGfcGfgUfcAfcCfaCfadTsdT |
| AM01001-AS | 474 | dTGfcUfuGfuUfgCfgGfuCfaCfcAfcdTsdT |
| AM01002-AS | 475 | dTGfgCfuUfgUfuGfcGfgUfcAfcCfadTsdT |
| AM01003-AS | 476 | dTAfaGfcAfcUfuUfaUfuGfaGfuUfcdTsdT |
| AM01004-AS | 477 | dTAfaAfgCfaCfuUfuAfuUfgAfgUfudTsdT |
| AM01005-AS | 478 | dTCfaAfaGfcAfcUfuUfaUfuGfaGfudTsdT |
| AM01006-AS | 479 | dTUfcAfaAfgCfaCfuUfuAfuUfgAfgdTsdT |
| AM01007-AS | 480 | dTUfuCfaAfaGfcAfcUfuUfaUfuGfadTsdT |
| AM01008-AS | 481 | dTUfuUfcAfaAfgCfaCfuUfuAfuUfgdTsdT |
| AM01009-AS | 482 | dTUfuUfuCfaAfaGfcAfcUfuUfaUfudTsdT |
| AM01377-AS | 483 | dTCfaUfcCfgUfcCfgUfuGfgUfcCfadTsdT |
| AM01378-AS | 484 | dTGfcAfuCfcGfuCfcGfuUfgGfuCfcdTsdT |
| AM01379-AS | 485 | dTGfgCfaUfcCfgUfcCfgUfuGfgUfcdTsdT |
| AM01380-AS | 486 | dTUfgGfcAfuCfcGfuCfcGfuUfgGfudTsdT |
| AM01381-AS | 487 | dTAfuGfgCfaUfcCfgUfcCfgUfuGfgdTsdT |
| AM01382-AS | 488 | dTCfaUfgGfcAfuCfcGfuCfcGfuUfgdTsdT |
| AM01383-AS | 489 | dTUfcAfuGfgCfaUfcCfgUfcCfgUfudTsdT |
| AM01384-AS | 490 | dTCfuCfaUfgGfcAfuCfcGfuCfcGfudTsdT |
| AM01385-AS | 491 | dTCfaGfaGfcCfcUfcAfuGfgCfaUfcdTsdT |
| AM01386-AS | 492 | dTGfcAfgAfgCfcCfuCfaUfgGfcAfudTsdT |
| AM01387-AS | 493 | dTAfcCfcCfaGfgAfgCfaGfcAfgAfgdTsdT |

TABLE 2-continued

Modified F12 RNAi trigger antisense strand sequences.

| Strand ID | SEQ ID No. | Antisense Sequence (5' → 3') |
|---|---|---|
| AM01388-AS | 494 | dTGfgGfaAfgUfgGfcAfgGfgCfuCfcdTsdT |
| AM01389-AS | 495 | dTUfgGfuAfcAfgCfuGfcCfgGfuGfgdTsdT |
| AM01390-AS | 496 | dTCfuGfgUfcCfuGfaUfcAfaAfgUfudTsdT |
| AM01391-AS | 497 | dTGfcUfgGfuCfcUfgAfuCfaAfaGfudTsdT |
| AM01392-AS | 498 | dTUfcGfcUfgGfuCfcUfgAfuCfaAfadTsdT |
| AM01393-AS | 499 | dTCfcAfuCfgCfuGfgUfcCfuGfaUfcdTsdT |
| AM01394-AS | 500 | dTCfcCfaUfcGfcUfgGfuCfcUfgAfudTsdT |
| AM01395-AS | 501 | dTUfcCfcCfaUfcGfcUfgGfuCfcUfgdTsdT |
| AM01396-AS | 502 | dTCfuUfuCfuUfgGfgCfuCfcAfaAfcdTsdT |
| AM01397-AS | 503 | dTAfcUfuUfcUfuGfgGfcUfcCfaAfadTsdT |
| AM01399-AS | 504 | dTCfuGfaGfcCfcGfcGfgCfcAfuCfadTsdT |
| AM01400-AS | 505 | dTUfcCfgAfgGfcCfcAfcGfgCfuGfadTsdT |
| AM01401-AS | 506 | dTCfuCfcGfaGfgCfcCfaCfgGfcUfgdTsdT |
| AM01402-AS | 507 | dTCfcUfcCfgAfgGfcCfcAfcGfgCfudTsdT |
| AM01403-AS | 508 | dTGfgUfgGfcCfuCfcGfaGfgCfcCfadTsdT |
| AM01404-AS | 509 | dTAfgGfuGfgCfuCfcGfaGfgCfcCfcdTsdT |
| AM01405-AS | 510 | dTUfaGfgUfgGfcCfuCfcGfaGfgCfcdTsdT |
| AM01406-AS | 511 | dTGfuAfgGfuGfgCfcUfcCfgAfgGfcdTsdT |
| AM01407-AS | 512 | dTGfuCfcCfcAfgUfuCfcGfcGfcUfudTsdT |
| AM01408-AS | 513 | dTUfuCfcGfgCfaGfaAfgGfcGfuGfgdTsdT |
| AM01409-AS | 514 | dTGfuUfcCfgGfcAfgAfaGfgCfgUfgdTsdT |
| AM01410-AS | 515 | dTGfgUfuCfcGfgCfaGfaAfgGfcGfudTsdT |
| AM01411-AS | 516 | dTCfcGfgGfuUfcCfgGfcAfgAfaGfgdTsdT |
| AM01412-AS | 517 | dTUfcCfgGfgUfuCfcGfgCfaGfaAfgdTsdT |
| AM01413-AS | 518 | dTGfuCfcGfgGfuUfcCfgGfcAfgAfadTsdT |
| AM01414-AS | 519 | dTUfgUfcCfgGfgUfuCfcGfgCfaGfadTsdT |
| AM01415-AS | 520 | dTCfgUfuGfuCfcGfgGfuUfcCfgGfcdTsdT |
| AM01416-AS | 521 | dTUfcGfuUfgUfcCfgGfgUfuCfcGfgdTsdT |
| AM01417-AS | 522 | dTUfuCfcUfgGfuCfaGfgGfaAfgGfcdTsdT |
| AM01418-AS | 523 | dTGfuUfcCfuGfgUfcAfgGfgAfaGfgdTsdT |
| AM01419-AS | 524 | dTCfgUfuCfcUfgGfuCfaGfgGfaAfgdTsdT |
| AM01420-AS | 525 | dTCfcGfuUfcCfuGfgUfcAfgGfgAfadTsdT |
| AM01421-AS | 526 | dTGfcCfgUfuCfcUfgGfuCfaGfgGfadTsdT |
| AM01422-AS | 527 | dTCfaGfuGfgGfcCfgUfuCfcUfgGfudTsdT |
| AM01423-AS | 528 | dTAfgCfuCfaGfuGfgGfcCfgUfuCfcdTsdT |
| AM01424-AS | 529 | dTGfaAfgAfcAfgAfcUfcUfuGfcGfgdTsdT |
| AM01425-AS | 530 | dTUfgCfcGfgCfgCfaGfaAfaCfuGfudTsdT |

TABLE 2-continued

Modified F12 RNAi trigger antisense strand sequences.

| Strand ID | SEQ ID No. | Antisense Sequence (5' → 3') |
|---|---|---|
| AM01426-AS | 531 | dTGfgCfgAfuGfaGfgCfuGfcCfgGfcdTsdT |
| AM01427-AS | 532 | dTGfgGfcGfaUfgAfgGfcUfgCfcGfgdTsdT |
| AM01428-AS | 533 | dTGfgGfgCfgAfuGfaGfgCfuGfcCfgdTsdT |
| AM01429-AS | 534 | dTAfcCfcAfgCfaGfgGfgGfcGfaUfgdTsdT |
| AM01430-AS | 535 | dTGfcAfcCfcAfgCfaGfgGfgGfcGfadTsdT |
| AM01431-AS | 536 | dTAfgCfaCfcCfaGfcAfgGfgGfgCfgdTsdT |
| AM01432-AS | 537 | dTUfcAfgCfaCfcCfaGfcAfgGfgGfgdTsdT |
| AM01433-AS | 538 | dTCfcGfaGfcAfcCfaCfcGfuCfaGfadTsdT |
| AM01434-AS | 539 | dTGfgCfcGfaGfcAfcCfaCfcGfuCfadTsdT |
| AM01435-AS | 540 | dTUfgGfcCfgAfgCfaCfcAfcCfgUfcdTsdT |
| AM01436-AS | 541 | dTUfcCfuGfgCfcGfaGfcAfcCfaCfcdTsdT |
| AM01437-AS | 542 | dTCfaGfcUfgCfcGfuCfcGfcAfuCfcdTsdT |
| AM01438-AS | 543 | dTGfgAfgCfgCfgCfaGfcUfgCfcGfudTsdT |
| AM01439-AS | 544 | dTAfcGfuAfaGfgCfgAfcAfgGfaGfcdTsdT |
| AM01440-AS | 545 | dTCfuGfaAfcGfuAfaGfgCfgAfcAfgdTsdT |
| AM01441-AS | 546 | dTCfuGfgCfaUfaUfuCfcUfcCfgCfcdTsdT |
| AM01442-AS | 547 | dTAfgCfuGfgCfaUfaUfuCfcUfcCfgdTsdT |
| AM01443-AS | 548 | dTGfaAfgCfuGfgCfaUfaUfuCfcUfcdTsdT |
| AM01444-AS | 549 | dTGfgAfaGfcUfgGfcAfuAfuUfcCfudTsdT |
| AM01445-AS | 550 | dTCfgGfgCfcUfcCfgGfaAfuCfaCfcdTsdT |
| AM01446-AS | 551 | dTGfcCfaCfuCfuCfuCfaCfuGfcGfgdTsdT |
| AM01447-AS | 552 | dTAfgCfcAfcUfcUfcUfcAfcUfgCfgdTsdT |
| AM01514-AS | 553 | dTAfaCfaGfaGfcCfgUfcAfuGfgCfgdTsdT |
| AM01515-AS | 554 | dTCfaAfcAfgAfgCfcGfuCfaUfgGfcdTsdT |
| AM01516-AS | 555 | dTAfcAfaCfaGfaGfcCfgUfcAfuGfgdTsdT |
| AM01517-AS | 556 | dTAfaCfaAfcAfgAfgCfcGfuCfaUfgdTsdT |
| AM01518-AS | 557 | dTGfaAfcAfaCfaGfaGfcCfgUfcAfudTsdT |
| AM01519-AS | 558 | dTGfgAfaCfaAfcAfgAfgCfcGfuCfadTsdT |
| AM01520-AS | 559 | dTCfgGfuGfgUfaCfuGfaAfaGfgGfadTsdT |
| AM01521-AS | 560 | dTUfuGfuGfgAfuGfcAfuUfuGfuGfgdTsdT |
| AM01522-AS | 561 | dTCfaAfgCfaGfuAfuCfcCfcAfuUfgdTsdT |
| AM01523-AS | 562 | dTCfuCfcAfaGfcAfgUfaUfcCfcCfadTsdT |
| AM01524-AS | 563 | dTGfcUfcCfaAfgCfaGfuAfuCfcCfcdTsdT |
| AM01525-AS | 564 | dTGfgGfcUfcCfaAfgCfaGfuAfuCfcdTsdT |
| AM01526-AS | 565 | dTGfuGfuUfuGfcUfgCfaAfuGfgUfcdTsdT |
| AM01527-AS | 566 | dTUfuCfcGfgUfaGfgUfgGfcCfuCfcdTsdT |

TABLE 2-continued

Modified F12 RNAi trigger antisense strand sequences.

| Strand ID | SEQ ID No. | Antisense Sequence (5' → 3') |
|---|---|---|
| AM01528-AS | 567 | dTGfuUfcCfgGfuAfgGfuGfgCfcUfcdTsdT |
| AM01529-AS | 568 | dTUfgUfuCfcCfgUfaGfgUfgGfcCfudTsdT |
| AM01530-AS | 569 | dTCfuCfaGfuCfaUfgUfuCfcGfgUfadTsdT |
| AM01531-AS | 570 | dTGfaCfgUfgUfgUfcAfuUfaUfcUfgdTsdT |
| AM01532-AS | 571 | dTGfgAfcGfuGfuGfuCfaUfuAfuCfudTsdT |
| AM01533-AS | 572 | dTUfgGfaCfgUfgUfgUfcAfuUfaUfcdTsdT |
| AM01534-AS | 573 | dTAfuGfgAfcGfuGfuGfuCfaUfuAfudTsdT |
| AM01535-AS | 574 | dTAfcCfaUfgGfaCfgUfgUfgUfcAfudTsdT |
| AM01536-AS | 575 | dTAfgUfcCfgCfcCfaCfcAfcGfcGfcdTsdT |
| AM01537-AS | 576 | dTUfaGfuCfcGfcCfcAfcCfaCfgCfgdTsdT |
| AM01538-AS | 577 | dTCfuAfgUfcCfgCfcCfaCfcAfcGfcdTsdT |
| AM01539-AS | 578 | dTAfcUfaGfuCfcGfcCfcAfcCfaCfgdTsdT |
| AM01540-AS | 579 | dTCfaGfaGfcCfaCfuAfgUfcCfgCfcdTsdT |
| AM01541-AS | 580 | dTGfuUfcCfuCfgGfgCfgCfuGfgCfcdTsdT |
| AM01542-AS | 581 | dTAfgUfaCfcAfcUfgUfcAfgUfuCfcdTsdT |
| AM01543-AS | 582 | dTUfcUfuGfaCfcAfaGfuAfcCfaCfudTsdT |
| AM01544-AS | 583 | dTGfaUfcUfuGfaCfcAfaGfuAfcCfadTsdT |
| AM01545-AS | 584 | dTCfgAfuCfuUfgAfcCfaAfgUfaCfcdTsdT |
| AM01546-AS | 585 | dTCfgAfuCfuUfgAfcCfaAfgUfaCfcdTsdT |
| AM01547-AS | 586 | dTUfcGfuGfaAfgGfcGfgUfaGfgAfgdTsdT |
| AM01548-AS | 587 | dTCfcUfcGfuGfaAfgGfcGfgUfaGfgdTsdT |
| AM01549-AS | 588 | dTCfcCfuCfgUfgAfaGfgCfgGfuAfgdTsdT |
| AM01550-AS | 589 | dTCfgCfaGfaGfcAfcUfgUfcUfcAfgdTsdT |
| AM01551-AS | 590 | dTCfuUfcAfgCfcCfcCfuCfgAfaCfudTsdT |
| AM01552-AS | 591 | dTUfcUfuCfaGfcCfcCfuCfgaAfcdTsdT |
| AM01553-AS | 592 | dTAfuUfcUfuCfaGfcCfcCfuCfgAfdTsdT |
| AM01554-AS | 593 | dTUfcUfcCfgUfgCfaCfgUfuAfgAfgdTsdT |
| AM01555-AS | 594 | dTCfgUfcUfcCfgUfgCfaCfgUfuAfgdTsdT |
| AM01556-AS | 595 | dTUfgGfcGfuCfuCfcGfuGfcAfcGfudTsdT |
| AM01621-AS | 596 | dACfuUfcCfaCfuUfuCfuUfgGfgCfudTsdT |
| AM01622-AS | 597 | dTCfuUfuC$_{UNA}$aCfuUfuCfuUfgGfgCfudTsdT |
| AM01623-AS | 598 | dTCfuUfuCfA$_{UNA}$CfuUfuCfuUfgGfgCfudTsdT |
| AM01624-AS | 599 | dTUfcUfuU$_{UNA}$cAfcUfuUfcUfuGfgGfcdTsdT |
| AM01625-AS | 600 | dTUfcUfuUfC$_{UNA}$AfcUfuUfcUfuGfgGfcdTsdT |
| AM01626-AS | 601 | dTGfuCfuU$_{UNA}$uCfaCfuUfuCfuUfgGfgdTsdT |
| AM01627-AS | 602 | dTGfuCfuUfU$_{UNA}$CfaCfuUfuCfuUfgGfgdTsdT |
| AM01628-AS | 603 | dAGfgUfcUfuUfcAfcUfuUfcUfuGfgdTsdT |

TABLE 2-continued

Modified F12 RNAi trigger antisense strand sequences.

| Strand ID | SEQ ID No. | Antisense Sequence (5' → 3') |
|---|---|---|
| AM01629-AS | 604 | dTGfgUfcU$_{UNA}$uUfcAfcUfuUfcUfuGfgdTsdT |
| AM01630-AS | 605 | dTGfgUfcUfU$_{UNA}$UfcAfcUfuUfcUfuGfgdTsdT |
| AM01631-AS | 606 | dTUfgGfuC$_{UNA}$uUfuCfaCfuUfuCfuUfgdTsdT |
| AM01632-AS | 607 | dTUfgGfuCfU$_{UNA}$UfuCfaCfuUfuCfuUfgdTsdT |
| AM01633-AS | 608 | dTGfaGfaA$_{UNA}$gCfuGfaGfgCfuCfaAfadTsdT |
| AM01634-AS | 609 | dTGfaGfaAfG$_{UNA}$CfuGfaGfgCfuCfaAfadTsdT |
| AM01903-AS | 610 | vpdTGfuCfuU$_{UNA}$uCfaCfuUfuCfuUfgGfgdTsdT |
| AM01904-AS | 611 | vpdTGfuCfuU$_{UNA}$uCfaCfuUfuCfuUfgGfgsdT |
| AM01906-AS | 612 | vpdTGfgUfcU$_{UNA}$uUfcAfcUfuUfcUfuGfgdTsdT |
| AM01907-AS | 613 | vpdTGfgUfcU$_{UNA}$uUfcAfcUfuUfcUfuGfgsdT |
| AM01909-AS | 614 | vpdTGfaGfaA$_{UNA}$gCfuGfaGfgCfuCfaAfadTsdT |
| AM01910-AS | 615 | vpdTGfaGfaA$_{UNA}$gCfuGfaGfgCfuCfaAfasdT |
| AM01915-AS | 616 | vpdTGfgUfcUfU$_{UNA}$UfcAfcUfuUfcUfuGfgdTsdT |
| AM01916-AS | 617 | vpdTGfgUfcUfU$_{UNA}$UfcAfcUfuUfcUfuGfgsdT |
| AM01917-AS | 618 | dTsGfsgUfcUfU$_{UNA}$UfcAfcUfuUfcUfuGfgsdT |
| AM01918-AS | 619 | dTsGfsuCfuU$_{UNA}$uCfaCfuUfuCfuUfgGfgsdT |
| AM01919-AS | 620 | dTsGfsgUfcU$_{UNA}$uUfcAfcUfuUfcUfuGfgsdT |
| AM01920-AS | 621 | dTsGfsaGfaA$_{UNA}$gCfuGfaGfgCfuCfaAfasdT |
| AM01921-AS | 622 | dTsGfsuCfuU$_{UNA}$uCfaCfuuuCfuUfgGfgsdT |
| AM01923-AS | 623 | dTsGfsgUfcU$_{UNA}$uUfcAfcuuUfcUfuGfgsdT |
| AM01925-AS | 624 | dTsGfsaGfaA$_{UNA}$gCfuGfaggCfuCfaAfasdT |
| AM01927-AS | 625 | dTsGfsgUfcUfU$_{UNA}$UfcAfcuuUfcUfuGfgsdT |
| AM01928-AS | 626 | usGfsgUfcUfU$_{UNA}$UfcAfcuuUfcUfuGfgsdT |
| AM01929-AS | 627 | usGfsgUfcU$_{UNA}$uUfcAfcuuUfcUfuGfgsdT |
| AM01930-AS | 628 | usGfsgUfcU$_{UNA}$uUfcAfcuuUfcUfuGfgGfcsusc |
| AM01931-AS | 629 | usGfsgUfcUfU$_{UNA}$UfcAfcuuUfcUfuGfgGfcsusc |
| AM01996-AS | 630 | dTGfgUfcU$_{UNA}$uUfcAfcuuUfcUfuGfgdTsdT |
| AM01997-AS | 631 | dTGfgUfcUfU$_{UNA}$UfcAfcuuUfcUfuGfgdTsdT |
| AM02060-AS | 632 | dTGfuCfuU$_{UNA}$uCfaCfuuuCfuUfgGfgdTsdT |
| AM02062-AS | 633 | dTGfaGfaA$_{UNA}$gCfuGfaggCfuCfaAfadTsdT |
| AM02112-AS | 634 | pdTGfgUfcUfuUfcAfcUfuUfcUfuGfgdTsdT |
| AM02113-AS | 635 | pdTGfgUfcU$_{UNA}$uUfcAfcUfuUfcUfuGfgdTsdT |
| AM02164-AS | 636 | dTsGfsgUfcU$_{UNA}$uUfcAfcuuUfcUfuGfgGfcuscsuAu |
| AM02165-AS | 637 | dTsGfsgUfcUfuUfcAfcuuUfcUfuGfgGfcuscsuAu |
| AM02166-AS | 638 | dTsGfsgUfcU$_{UNA}$uUfcAfcuuUfcUfuGfgGfcucusdTsdT |
| AM02167-AS | 639 | dTsGfsgUfcUfuUfcAfcuuUfcUfuGfgGfcucusdTsdT |

TABLE 2-continued

Modified F12 RNAi trigger antisense strand sequences.

| Strand ID | SEQ ID NO. | Antisense Sequence (5' → 3') |
|---|---|---|
| AM02171-AS | 640 | dTsGfsgUfcUfuUfcAfcuuUfcUfuGfgGfcuscsu |
| AM02172-AS | 641 | dTsGfsgUfcUfuUfcAfcuuUfcUfuGfgGfcsusc |
| AM02197-AS | 642 | dTsCfsuUfuCfaCfuUfucuUfgGfcCfuCfcsasa |
| AM02198-AS | 643 | dTsUfscUfuUfcAfcUfuucUfuGfgGfcUfcscsa |
| AM02199-AS | 644 | dTsGfsuCfuUfuCfaCfuuuCfuUfgGfgCfuscsc |
| AM02200-AS | 645 | dTsUfsgGfuCfuUfuCfacuUfcUfuGfgscsu |
| AM02201-AS | 646 | dTsGfsaGfaAfgCfuGfaggCfuCfaAfaGfcsasc |
| AM02208-AS | 647 | dTsGfsgUfcUfuUfcAfcuuUfcUfuGfgGfcsuscuAu |
| AM02331-AS | 648 | dTsGfsgUfcU$_{UNA}$uUfcAfcUfuUfcUfuGfgGfcuscsuAu |
| AM02332-AS | 649 | dTsGfsgUfcUfU$_{UNA}$UfcAfcUfuUfcUfuGfgGfcuscsuAu |
| AM02333-AS | 650 | dTsGfsgUfcUfuU$_{UNA}$cAfcUfuUfcUfuGfgGfcuscsuAu |
| AM02334-AS | 651 | dTsGfsgUfcUfuUfC$_{UNA}$AfcUfuUfcUfuGfgGfcuscsuAu |
| AM02335-AS | 652 | dTsGfsgUfcUfuUfcA$_{UNA}$cUfuUfcUfuGfgGfcuscsuAu |
| AM02336-AS | 653 | dTsGfsgUfcUfuUfcAfC$_{UNA}$UfuUfcUfuGfgGfcuscsuAu |
| AM02337-AS | 654 | dTsGfsgUfcUfuUfcAfcU$_{UNA}$uUfcUfuGfgGfcuscsuAu |
| AM02338-AS | 655 | dTsGfsgUfcUfuUfcAfcUfU$_{UNA}$UfcUfuGfgGfcuscsuAu |
| AM02339-AS | 656 | dTsGfsgUfcUfuUfcAfcUfuU$_{UNA}$cUfuGfgGfcuscsuAu |
| AM02340-AS | 657 | dTsGfsgUfcUfuUfcAfcUfuUfC$_{UNA}$UfuGfgGfcuscsuAu |
| AM02348-AS | 658 | dTsGfsgUfcUfuUfcAfcUfuUfcUfuGfgGfcuscsuAu |
| AM02349-AS | 659 | dTsGfsgUfcUfuUfcAfcuUfUfcUfuGfgGfcuscsuAu |
| AM02350-AS | 660 | dTsGfsgUfcUfuUfcAfcuUfucUfuGfgGfcuscsuAu |
| AM02354-AS | 661 | dTsGfsgUfcUfuUfcAfcUfUfuCfuUfgGfgCfusCfsuAu |
| AM02395-AS | 662 | dTsGfsaGfaAfgCfuGfaGfgCfuCfaAfaGfcascsuAu |
| AM02396-AS | 663 | dTsGfsaGfaAfgCfuGfagGfCfuCfaAfaGfcascsuAu |
| AM02397-AS | 664 | dTsGfsaGfaAfgCfuGfagGfcuCfaAfaGfcascsuAu |
| AM02398-AS | 665 | dTsGfsaGfaAfgCfuGfaGfGfcUfcAfaAfgCfasCfsuAu |
| AM02432-AS | 666 | dTsGfsgUfcUfuUfcAfcUfUfcUfuGfgGfcasusAua |
| AM02433-AS | 667 | dTsGfsgUfcUfuUfcAfcUfUfcUfuGfgGfcauAfsusa |
| AM02434-AS | 668 | dTsGfsgUfcUfuUfcAfcUfUfcUfuGfgGfcUfcasusAua |
| AM02437-AS | 669 | dTsGfsaGfaAfgCfuGfaGfgCfuCfaAfaGfcasusAua |
| AM02438-AS | 670 | dTsGfsaGfaAfgCfuGfaGfgCfuCfaAfaGfcauAfsusa |
| AM02439-AS | 671 | dTsGfsaGfaAfgCfuGfaGfgCfuCfaAfaGfcAfcasusAua |
| AM02460-AS | 672 | pdTsGfsgUfcUfuUfcAfcuuUfcUfuGfgGfcuscsuAu |
| AM02461-AS | 673 | pdTsGfsgUfcUfuUfcAfcuuUfcUfuGfgGfcuscsuA |
| AM02462-AS | 674 | dTsGfsgUfcUfuUfcAfcuuUfcUfuGfgGfcuscsuA |
| AM02464-AS | 675 | dTsCfsaCfuUfuCfuUfgGfgCfuCfcAfaAfcAfsgsuAu |
| AM02466-AS | 676 | dTsUfscAfcUfuUfcUfuGfgGfcUfcCfaAfaCfsasuAu |

TABLE 2-continued

Modified F12 RNAi trigger antisense strand sequences.

| Strand ID | SEQ ID NO. | Antisense Sequence (5' → 3') |
|---|---|---|
| AM02468-AS | 677 | dTsUfsuCfaCfuUfuCfuUfgGfgCfuCfcAfaAfscsuAu |
| AM02470-AS | 678 | dTsUfsuUfcAfcUfuUfcUfuGfgGfcUfcCfaAfsasuAu |
| AM02472-AS | 679 | dTsAfsgCfuGfaGfgCfuCfaAfaGfcAfcUfuCfsusuAu |
| AM02474-AS | 680 | dTsGfsaAfgCfuGfaGfgCfuCfaAfaGfcAfcUfsusuAu |
| AM02476-AS | 681 | dTsUfsuGfuUfgCfgGfuCfaCfcAfcAfgCfcCfsgsuAu |
| AM02478-AS | 682 | dTsGfscUfuGfuUfgCfgGfuCfaCfcAfcAfgCfscsuAu |
| AM02480-AS | 683 | dTsGfsgCfuUfgUfuGfcGfgUfcAfcCfaCfaGfscsuAu |
| AM02487-AS | 684 | dTsGfgUfcUfuUfcAfcuUfUfcUfuGfgGfcucsuAu |
| AM02488-AS | 685 | dTsGfgUfcUfuUfcAfcuUfUfcUfuGfgGfcucuAu |
| AM02492-AS | 686 | dTsGfgUfcUfuUfcAfcuuUfcUfuGfgGfcucsuAu |
| AM02493-AS | 687 | dTsGfgUfcUfuUfcAfcuuUfcUfuGfgGfcucuAu |
| AM02502-AS | 688 | dTsGfgUfcUfuUfcAfcUfUfucUfuGfgGfcucsuAu |
| AM02503-AS | 689 | dTsGfgUfcUfuUfcAfcUfUfucUfuGfgGfcucuAu |
| AM02504-AS | 690 | dTsGfgUfcUfuUfcAfcUfuuCfUfuGfgGfcucsuAu |
| AM02505-AS | 691 | dTsGfgUfcUfuUfcAfcUfuuCfUfuGfgGfcucuAu |
| AM02506-AS | 692 | dTsGfgUfcUfuUfcAfcUfuUfCfuuGfgGfcucsuAu |
| AM02507-AS | 693 | dTsGfgUfcUfuUfcAfcUfuUfCfuuGfgGfcucuAu |
| AM02543-AS | 694 | dTsGfgUfcUfuUfcAfcUfU$_{UNA}$UfcUfuGfgGfcucsuAu |
| AM02544-AS | 695 | dTsGfgUfcUfuUfcA$_{UNA}$cUfuUfcUfuGfgGfcucsuAu |
| AM02579-AS | 696 | dTsgsuCfuUfuCfaCfuuuCfuUfgggCfuscsc |
| AM02582-AS | 697 | dTsUfsgguCfuUfuCfacuUfuCfuUfgggscsu |
| AM02585-AS | 698 | dTsgsaGfaAfgCfuGfaggCfuCfaAfagcsasc |
| AM02631-AS | 699 | dTsGfgUfcUfuUfcAfcuUfUfcUfuGfgGfcusCUAU |
| AM02632-AS | 700 | dTsGfgUfcUfuUfcAfcuUfUfcUfuGfgGfcusCuAfu |
| AM02633-AS | 701 | dTsGfgUfcUfuUfcAfcuUfUfcUfuGfgGfcusCuau |
| AM02640-AS | 702 | dTsGfgUfcU$_{UNA}$uUfcAfcuUfUfcUfuGfgGfcucsuAu |
| AM02641-AS | 703 | dTGfgUfcU$_{UNA}$uUfcAfcUfuUfcUfuGfgdTsdT(PAZ) |
| AM02642-AS | 704 | dTGfgUfcU$_{UNA}$uUfcAfcUfuUfcUfuGfg(PAZ) |
| AM02643-AS | 705 | dTGfgUfcU$_{UNA}$uUfcAfcUfuUfcUfuGfX(PAZ) |
| AM02644-AS | 706 | dTGfgUfcU$_{UNA}$uUfcAfcUfuUfcUfuXX(PAZ) |
| AM02645-AS | 707 | dTGfgUfcUfuUfcAfcUfuUfcUfuGfgdTsdT(PAZ) |
| AM02646-AS | 708 | dTGfgUfcUfuUfcAfcUfuUfcUfuGfg(PAZ) |
| AM02647-AS | 709 | dTGfgUfcUfuUfcAfcUfuUfcUfuGfX(PAZ) |
| AM02648-AS | 710 | dTGfgUfcUfuUfcAfcUfuUfcUfuXX(PAZ) |
| AM02650-AS | 711 | dTsgsgUfcUfuUfcAfcuuUfcUfugggcsusc |
| AM02656-AS | 712 | usGfsgUfcUfuUfcAfcuuUfcUfuGfgGfcsuscuAu |

TABLE 2-continued

Modified F12 RNAi trigger antisense strand sequences.

| Strand ID | SEQ ID No. | Antisense Sequence (5' → 3') |
|---|---|---|
| AM02657-AS | 713 | usGfsaAfgCfuGfaGfgCfuCfaAfaGfcAfcUfsusuAu |
| AM02658-AS | 714 | dTsgsaAfgCfuGfaGfgCfuCfaAfaGfcAfcUfsusuAu |
| AM02659-AS | 715 | dTsGfsaAfgCfugaGfgCfuCfaAfaGfcAfcUfsusuAu |
| AM02660-AS | 716 | dTsGfsaAfgCfuGfaggCfuCfaAfaGfcAfcUfsusuAu |
| AM02661-AS | 717 | dTsGfsaAfgCfuGfaGfgCfuCfaAfagcAfcUfsusuAu |
| AM02662-AS | 718 | dTsgsaAfgCfugaggCfuCfaAfagcAfcUfsusuAu |
| AM02691-AS | 719 | usCfsaCfuUfuCfuUfgGfgCfuCfcAfXs(PAZ) |
| AM02692-AS | 720 | usUfscAfcUfuUfcUfuGfgGfcUfcCfXs(PAZ) |
| AM02693-AS | 721 | usUfsuCfaCfuUfuCfuUfgGfgCfuCfXs(PAZ) |
| AM02694-AS | 722 | usUfsuUfcAfcUfuUfcUfuGfgGfcUfXs(PAZ) |
| AM02695-AS | 723 | usCfsuUfuCfaCfuUfuCfuUfgGfgCfXs(PAZ) |
| AM02696-AS | 724 | usUfscUfuUfcAfcUfuUfcUfuGfgGfXs(PAZ) |
| AM02697-AS | 725 | usGfsuCfuUfuCfaCfuUfuCfuUfgGfXs(PAZ) |
| AM02698-AS | 726 | usGfsgUfcUfuUfcAfcUfuUfcUfuGfXs(PAZ) |
| AM02699-AS | 727 | usUfsgGfuCfuUfuCfaCfuUfuCfuUfXs(PAZ) |
| AM02700-AS | 728 | usAfsgCfuGfaGfgCfuCfaAfaGfcAfXs(PAZ) |
| AM02701-AS | 729 | usGfsaAfgCfuGfaGfgCfuCfaAfaGfXs(PAZ) |
| AM02702-AS | 730 | usGfsaGfaAfgCfuGfaGfgCfuCfaAfXs(PAZ) |
| AM02703-AS | 731 | usUfsuGfuUfgCfgGfuCfaCfcAfcAfXs(PAZ) |
| AM02704-AS | 732 | usCfsuUfgUfuGfcGfgUfcAfcCfaCfXs(PAZ) |
| AM02705-AS | 733 | usGfscUfuGfuUfgCfgGfuCfaCfcAfXs(PAZ) |
| AM02706-AS | 734 | usGfsgCfuUfgUfuGfcGfgUfcAfcCfXs(PAZ) |
| AM02707-AS | 735 | usCfsaCfuUfuCfuUfgGfgCfuCfcXXs(PAZ) |
| AM02708-AS | 736 | usUfscAfcUfuUfcUfuGfgGfcUfcXXs(PAZ) |
| AM02709-AS | 737 | usUfsuCfaCfuUfuCfuUfgGfgCfuXXs(PAZ) |
| AM02710-AS | 738 | usUfsuUfcAfcUfuUfcUfuGfgGfcXXs(PAZ) |
| AM02711-AS | 739 | usCfsuUfuCfaCfuUfuCfuUfgGfgXXs(PAZ) |
| AM02712-AS | 740 | usUfscUfuUfcAfcUfuUfcUfuGfgXXs(PAZ) |
| AM02713-AS | 741 | usGfsuCfuUfuCfaCfuUfuCfuUfgXXs(PAZ) |
| AM02714-AS | 742 | usGfsgUfcUfuUfcAfcUfuUfcUfuXXs(PAZ) |
| AM02715-AS | 743 | usUfsgGfuCfuUfuCfaCfuUfuCfuXXs(PAZ) |
| AM02716-AS | 744 | usAfsgCfuGfaGfgCfuCfaAfaGfcXXs(PAZ) |
| AM02717-AS | 745 | usGfsaAfgCfuGfaGfgCfuCfaAfaXXs(PAZ) |
| AM02718-AS | 746 | usGfsaGfaAfgCfuGfaGfgCfuCfaXXs(PAZ) |
| AM02719-AS | 747 | usUfsuGfuUfgCfgGfuCfaCfcAfcXXs(PAZ) |
| AM02720-AS | 748 | usCfsuUfgUfuGfcGfgUfcAfcCfaXXs(PAZ) |
| AM02721-AS | 749 | usGfscUfuGfuUfgCfgGfuCfaCfcXXs(PAZ) |

TABLE 2-continued

Modified F12 RNAi trigger antisense strand sequences.

| Strand ID | SEQ ID No. | Antisense Sequence (5' → 3') |
|---|---|---|
| AM02722-AS | 750 | usGfsgCfuUfgUfuGfcGfgUfcAfcXXs(PAZ) |
| AM02846-AS | 751 | pdTsGfgUfcUfuUfcAfcuUfUfcUfuGfgGfcucsuAu |
| AM02847-AS | 752 | pdTsGfgUfcUfuUfcAfcUfuUfCfuuGfgGfcucuAu |
| AM02871-AS | 753 | usGfgUfcUfuUfcAfcUfuUfCfuuGfgGfcucuAu |
| AM02874-AS | 754 | dTsGfgUfcUfuUfcAfcUfuUfCfuuGfgGfcucuA |
| AM02875-AS | 755 | GfgUfcUfuUfcAfcUfuUfCfuuGfgGfcucuA |
| AM02876-AS | 756 | gUfcUfuUfcAfcUfuUfCfuuGfgGfcucuA |
| AM02877-AS | 757 | UfcUfuUfcAfcUfuUfCfuuGfgGfcucuA |
| AM02878-AS | 758 | pdTsGfgUfcUfuUfcAfcUfuUfCfuuGfgGfcucuA |
| AM02879-AS | 759 | pGfgUfcUfuUfcAfcUfuUfCfuuGfgGfcucuA |
| AM02880-AS | 760 | pgUfcUfuUfcAfcUfuUfCfuuGfgGfcucuA |
| AM02881-AS | 761 | pUfcUfuUfcAfcUfuUfCfuuGfgGfcucuA |
| AM02882-AS | 762 | GfgUfcUfuUfcAfcUfuUfCfuuGfgGfcucuAu |
| AM02883-AS | 763 | pGfgUfcUfuUfcAfcUfuUfCfuuGfgGfcucuAu |
| AM02884-AS | 764 | dTsGfgUfcUfuUfcAfcUfuUfCfuuGfgGfcucu |
| AM02885-AS | 765 | pdTsGfgUfcUfuUfcAfcUfuUfCfuuGfgGfcucu |
| AM02953-AS | 766 | usgsgUfcUfuUfcAfcuuUfcUfugggcsuscuAu |
| AM02962-AS | 767 | usGfsgUfcUfuUfcAfcuuUfcUfugggcsuscuAu |
| AM02963-AS | 768 | usGfsgUfcUfuucAfcuuUfcuugggcsuscuAu |
| AM02964-AS | 769 | usGfsgUfcuuUfcAfcuuUfcuugggcsuscuAu |
| AM02965-AS | 770 | usGfsgucUfuUfcAfcuuUfcuugggcsuscuAu |
| AM02966-AS | 771 | usGfsgUfcuuucAfcuuUfcUfugggcsuscuAu |
| AM02967-AS | 772 | usGfsgucUfuucAfcuuUfcUfugggcsuscuAu |
| AM02968-AS | 773 | usGfsgucuuUfcAfcuuUfcUfugggcsuscuAu |
| AM02969-AS | 774 | usGfsgUfCfUfuucAfcuuUfcuugggcsuscuAu |
| AM02970-AS | 775 | usGfsgUfCfuuUfcAfcuuUfcuugggcsuscuAu |
| AM02971-AS | 776 | usGfsguCfUfuUfcAfcuuUfcuugggcsuscuAu |
| AM02996-AS | 777 | gsgUfcUfuUfcAfcuuUfcUfugggcsuscuAu |
| AM02997-AS | 778 | gUfcUfuUfcAfcuuUfcUfugggcsuscuAu |
| AM03024-AS | 779 | dTGfgUfcUfuUfcAfcUfuUfCfuuGfgGfcucuAu |
| AM03026-AS | 780 | gUfcUfuUfcAfcUfuUfCfuuGfgGfcucuAu |
| AM03075-AS | 781 | usCfsaCfuUfuCfuUfgGfgCfuCfcXX |
| AM03076-AS | 782 | usCfsuUfuCfaCfuUfuCfuUfgGfgXX |
| AM03077-AS | 783 | usGfsgUfcUfuUfcAfcUfuUfcUfuXX |
| AM03078-AS | 784 | usUfsgGfuCfuUfuCfaCfuUfuCfuXX |
| AM03109-AS | 785 | usGfsgUfcUfuUfcAfcuuUfcUfuGfgGfcsTMsCMuAu |

TABLE 2-continued

Modified F12 RNAi trigger antisense strand sequences.

| Strand ID | SEQ ID No. | Antisense Sequence (5' → 3') |
|---|---|---|
| AM03110-AS | 786 | usGfsgUfcUfuUfcAfcuuUfcUfuGfgGfcTMCMuAu |
| AM03111-AS | 787 | usGfsgUfcUfuUfcAfcuuUfcUfuGfgGfcucuAu |
| AM03154-AS | 788 | usGfsgucuuucacuuUfcuugggcsuscuAu |
| AM03155-AS | 789 | usGfsgucuuucAfcuuUfcuugggcsuscuAu |
| AM03156-AS | 790 | usGfsgucuuUfcacuuUfcuugggcsuscuAu |
| AM03157-AS | 791 | usGfsgucuuUfcAfcuuUfcuugggcsuscuAu |
| AM03201-AS | 792 | dTsGfgUfcUfuUfcAfcUfuUfCfuuGfgGfcuc |
| AM03202-AS | 793 | pdTsGfgUfcUfuUfcAfcUfuUfCfuuGfgGfcuc |
| AM03203-AS | 794 | GfgUfcUfuUfcAfcUfuUfCfuuGfgGfcucu |
| AM03204-AS | 795 | pGfgUfcUfuUfcAfcUfuUfCfuuGfgGfcucu |
| AM03205-AS | 796 | dTsGfgUfcUfuUfcAfcUfuUfCfuuGfgGfcu |
| AM03206-AS | 797 | pdTsGfgUfcUfuUfcAfcUfuUfCfuuGfgGfcu |
| AM03207-AS | 798 | GfgUfcUfuUfcAfcUfuUfCfuuGfgGfcuc |
| AM03208-AS | 799 | pGfgUfcUfuUfcAfcUfuUfCfuuGfgGfcuc |
| AM03211-AS | 800 | usGfsguCfUfuUfcAfcuuUfcuugggcsuscuau |
| AM03212-AS | 801 | usGfsguCfUfuUfcAfcuuUfcuugggcsuscudAu |
| AM03215-AS | 802 | uAusGfsguCfUfuUfcAfcuuUfcuugggcsuscu |
| AM03342-AS | 803 | usCfsuUfuCfaCfuUfuCfuUfgGfgXsXs(PAZ) |
| AM03343-AS | 804 | usCfsuUfuCfaCfuUfuCfuUfgGfgXsX(PAZ) |
| AM03344-AS | 805 | usCfsuUfuCfaCfuUfuCfuUfgGfgXsX |
| AM03345-AS | 806 | usCfsuUfuCfaCfuUfuCfuUfgGfgXs(PAZ) |
| AM03346-AS | 807 | usCfsuUfuCfaCfuUfuCfuUfgGfgs(PAZ) |
| AM03347-AS | 808 | usCfsuUfuCfaCfuUfuCfuUfgGfgRRs(PAZ) |
| AM03348-AS | 809 | usCfsuUfuCfaCfuUfuCfuUfgGfg(C3)(C3)s(PAZ) |
| AM03349-AS | 810 | usCfsuUfuCfaCfuUfuCfuUfgGfg(Sp9)s(PAZ) |
| AM03350-AS | 811 | usCfsuUfuCfaCfuUfuCfuUfgGfg(Sp18)s(PAZ) |
| AM03351-AS | 812 | usCfsuUfuCfaCfuUfuCfuUfgGfg(C12)s(PAZ) |
| AM03352-AS | 813 | usCfsuUfuCfaCfuUfuCfuUfgGfg(C3)s(PAZ) |
| AM03353-AS | 814 | usCfsuUfuCfaCfuUfuCfuUfgGfgXX(PAZ) |
| AM03359-AS | 815 | usCfsuuuCfaCfuuuCfuUfgggXXs(PAZ) |
| AM03365-AS | 816 | usGfsgUfcUfuUfcacuuUfcuuXXs(PAZ) |
| AM03366-AS | 817 | usGfsgucuuucAfcUfuUfcUfuXXs(PAZ) |
| AM03367-AS | 818 | dTsGfgUfcUfuUfcAfcUfuUfCfuuGfgGfc |
| AM03368-AS | 819 | pdTsGfgUfcUfuUfcAfcUfuUfCfuuGfgGfc |
| AM03410-AS | 820 | uAusGfsgucuuUfcAfcuuUfcuugggcsuscu |
| AM03415-AS | 821 | usGfsgucuuUfcAfcuuUfcuugggscsucuAu |
| AM03416-AS | 822 | usGfsgucuuUfcAfcuuUfcuuggsgscucuAu |

TABLE 2-continued

Modified F12 RNAi trigger antisense strand sequences.

| Strand ID | SEQ ID No. | Antisense Sequence (5' → 3') |
|---|---|---|
| AM03417-AS | 823 | usGfsgucuuUfcAfcuuUfcuugggcsuscuAu |
| AM03418-AS | 824 | usGfgucuuUfcAfcuuUfcuugggcsuscuAu |
| AM03419-AS | 825 | usGfgucuuUfcAfcuuUfcuugggcuscuAu |
| AM03483-AS | 826 | vpdTGfsgucuuUfcAfcuuUfcuugggcsuscuAu |
| AM03484-AS | 827 | vpdTsGfsgucuuUfcAfcuuUfcuugggcsuscuAu |
| AM03485-AS | 828 | dTsGfsgucuuUfcAfcuuUfcuugggcsuscuAu |
| AM03580-AS | 829 | usGfsgucuuUfcAfcuuUfcuugggcsusucAu |
| AM03581-AS | 830 | usGfsgucuuUfcAfcuuUfcuugggcsuscuau |
| AM03584-AS | 831 | dTsGfgUfcUfuUfcAfcUfuUfCfuuGfgGfcauaUa |
| AM03585-AS | 832 | dTsGfgUfcUfuUfcAfcUfuUfCfuuGfgGfcucuau |
| AM03589-AS | 833 | uuAusGfsgucuuUfcAfcuuUfcuugggcsusc |
| AM03590-AS | 834 | uGAusGfsgucuuUfcAfcuuUfcuugggcsusc |
| AM03643-AS | 835 | (NH2-C6)usGfsgucuuUfcAfcuuUfcuugggcsuscuAu |
| AM03644-AS | 836 | (Cy5-C6)usGfsgucuuUfcAfcuuUfcuugggcsuscuAu |
| AM03662-AS | 1322 | usGfsGfucuuUfcAfcuuUfcuugggcsuscuAu |
| AM03663-AS | 1323 | usGfsGfucuuUfCfaCfuuUfcuugggcsuscuAu |
| AM03664-AS | 1324 | usGfsgucuuUfCfaCfuuUfcuugggcsuscuAu |
| AM03665-AS | 1325 | usGfsguCfuuUfCfaCfuuUfcuugggcsuscuAu |
| AM03666-AS | 1326 | usGfsguCfuuuCfaCfuuUfcuugggcsuscuAu |
| AM03667-AS | 1327 | usGfsGfucuuuCfaCfuuUfcuugggcsuscuAu |
| AM03668-AS | 1328 | usGfsgucuuUfcAfcuuUfcuugggcsus(invdA)uAu |
| AM03732-AS | 1329 | usCfsuUfuCfaCfuUfuCfuUfgMGMXXs(PAZ) |
| AM03733-AS | 1330 | usCfsuUfuCfaCfuUfuCfuUfgsGfsgXXs(PAZ) |
| AM03734-AS | 1331 | usCfsuUfuCfaCfuUfuCfuUfgsGfsgXX(PAZ) |
| AM03735-AS | 1332 | asCfsuUfuCfaCfuUfuCfuUfgGfgXXs(PAZ) |
| AM03736-AS | 1333 | usCfsuuuCfaCfuuuCfuUfgMGMXXs(PAZ) |
| AM03737-AS | 1334 | asCfsuuuCfaCfuuuCfuUfgggXXs(PAZ) |
| AM03785-AS | 1335 | usGfsgucuuUfcAfcuuUfcuugggcsuscudAu |
| AM03786-AS | 1336 | usGfsgucuuUfcAfcuuUfcuugggcsasuuau |
| AM03787-AS | 1337 | usGfsgucuuUfcAfcuuUfcuugggcsuscaua |
| AM03788-AS | 1338 | usGfsgucuuUfcAfcuuUfcuugggcsuscu(invdA)u |
| AM03789-AS | 1339 | asGfsgucuuUfcAfcuuUfcuugggcsuscuau |
| AM03790-AS | 1340 | (invdA)sGfsgucuuUfcAfcuuUfcuugggcsuscuau |
| AM03791-AS | 1341 | XsGfsgucuuUfcAfcuuUfcuugggcsuscuau |
| AM03792-AS | 1342 | (invX)sGfsgucuuUfcAfcuuUfcuugggcsuscuau |
| AM03793-AS | 1343 | (invu)sGfsgucuuUfcAfcuuUfcuugggcsuscuau |

TABLE 2-continued

Modified F12 RNAi trigger antisense strand sequences.

| Strand ID | SEQ ID No. | Antisense Sequence (5' → 3') |
|---|---|---|
| AM03794-AS1344 | | (3'OMeu)sGfsgucuuUfcAfcuuUfcuugggcsuscuau |
| AM03795-AS1345 | | usCfsgucuuUfcAfcuuUfcuugggcsuscuau |
| AM03796-AS1346 | | usAfsgucuuUfcAfcuuUfcuugggcsuscuau |
| AM03797-AS1347 | | usUfsgucuuUfcAfcuuUfcuugggcsuscuau |
| AM03798-AS1348 | | usdGsgucuuUfcAfcuuUfcuugggcsuscuau |
| AM03799-AS2187 | | (S03)usGfsgucuuUfcAfcuuUfcuugggcsuscuAu |
| AM03803-AS2188 | | usGfsgucuuUfcAfcuuUfcuugggcsuscacag |
| AM03804-AS2189 | | usGfsgucuuUfcAfcuuUfcuugggcsuscagu |
| AM03805-AS2190 | | usGfsgucuuUfcAfcuuUfcuugggcsuscgcg |
| AM03808-AS2191 | | usGfsgucuuUfcAfcuuUfcuugggcsuscaa |
| AM03809-AS2192 | | usCfsuUfuCfaCfuUfuCfuUfgGfG$_{LNA}$XXs(PAZ) |
| AM03810-AS2193 | | usCfsuUfuCfaCfuUfuCfuUfgG$_{LNA}$gXXs(PAZ) |
| AM03811-AS2194 | | usCfsuUfuCfaCfuUfuCfuUfgG$_{LNA}$G$_{LNA}$XXs(PAZ) |
| AM03819-AS2195 | | usGfANAsgucuuUfcAfcuuUfcuugggcsuscuau |
| AM03820-AS2196 | | usGfsgucuuUfANAcAfcuuUfcuugggcsuscuau |
| AM03821-AS2197 | | usGfsgucuuUfcAfANAcuuUfcuugggcsuscuau |
| AM03822-AS2198 | | usGfsgucuuUfcAfcuuUfANAcuugggcsuscuau |
| AM03832-AS2199 | | usCfsuUfuCfaCfuUfuCfuUfgGfgsXsXs(PAZ) |
| AM03833-AS2200 | | usCfsuUfuCfaCfuUfuCfuUfgGfgs(C12)s(PAZ) |
| AM03851-AS2201 | | usGfsgucuuUfcAfcuuUfcuugggcucusasu |
| AM03852-AS2202 | | usGfsgucuuUfcAfcuuUfcuugggcucu(invdA)u |
| AM03853-AS2203 | | usGfsgucuuUfcAfcuuUfcuugggcucuAMTM |
| AM03854-AS2204 | | usGfsgucuuUfcAfcuuUfcuugggcucusAMsTM |
| AM03855-AS2205 | | TMsGfsgucuuUfcAfcuuUfcuugggcsuscuAu |
| | 2053 | dTUfcGfaAfaGfuGfuUfgAfcUfcCfadTsdT |
| | 2054 | dTAfuCfgAfaAfgUfgUfuGfaCfuCfcdTsdT |
| | 2055 | dTGfuAfcUfuAfuGfcUfcCfuUfgGfgdTsdT |
| | 2056 | dTUfgUfaCfuUfaUfgCfuCfcUfuGfgdTsdT |
| | 2057 | dTUfuGfuAfcUfuAfuGfcUfcCfuUfgdTsdT |
| | 2058 | dTCfaGfcUfuUfgUfaCfuUfaUfgCfudTsdT |
| | 2059 | dTAfcGfaCfuGfuGfuGfcUfcUfuCfadTsdT |
| | 2060 | dTAfaCfgAfcUfgUfgUfgCfuCfuUfcdTsdT |
| | 2061 | dTGfaAfcGfaCfuGfuGfuGfcUfcUfudTsdT |
| | 2062 | dTAfcAfgUfgAfgAfaCfgAfcUfgUfgdTsdT |
| | 2063 | dTUfgAfcAfgUfgAfgAfaCfgAfcUfgdTsdT |
| | 2064 | dTGfuAfcAfuUfuGfuGfgUfaCfaGfcdTsdT |
| | 2065 | dTGfgUfaCfaUfuUfgUfgGfuAfcAfgdTsdT |

TABLE 2-continued

Modified F12 RNAi trigger antisense strand sequences.

| Strand ID | SEQ ID No. | Antisense Sequence (5' → 3') |
|---|---|---|
| | 2066 | dTGfgGfuAfcAfuUfuGfuGfgUfaCfadTsdT |
| | 2067 | dTUfuGfuGfgGfuAfcAfuUfuGfuGfgdTsdT |
| | 2068 | dTAfcCfcUfuGfcAfcUfgGfcAfuCfudTsdT |
| | 2069 | dTCfcUfcUfaGfgCfaGfcGfaCfcCfcdTsdT |
| | 2070 | dTCfgCfgGfcCfaUfcAfuAfgCfaGfcdTsdT |
| | 2071 | dTCfcGfcGfgCfcAfuCfaUfaGfcAfgdTsdT |
| | 2072 | dTUfaGfcUfgAfgCfcCfgCfgGfcCfadTsdT |
| | 2073 | dTCfgGfuAfgCfuGfaGfcCfcGfcGfgdTsdT |
| | 2074 | dTGfcAfcCfcGfaGfaGfcGfuGfgUfcdTsdT |
| | 2075 | dTCfgCfaCfcCfgAfgAfgCfgUfgGfudTsdT |
| | 2076 | dTGfcGfcAfcCfcGfaGfaGfcGfuGfgdTsdT |
| | 2077 | dTGfuCfcCfcAfgUfuCfcGfcGfcUfudTsdT |
| | 2078 | dTGfgCfgUfgGfcCfgCfcCfaGfuCfcdTsdT |
| | 2079 | dTCfgUfuGfuCfcGfgGfuUfcCfgGfcdTsdT |
| | 2080 | dTGfuCfgUfuGfuCfcGfgGfuUfcCfgdTsdT |
| | 2081 | dTUfgUfcGfuUfgUfcCfgGfgUfuCfcdTsdT |
| | 2082 | dTAfuGfuCfgUfuGfuCfcGfgGfuUfcdTsdT |
| | 2083 | dTGfcGfgAfuGfuCfgUfuGfuCfcGfgdTsdT |
| | 2084 | dTAfcGfgGfcGfgAfuGfuCfgUfuGfudTsdT |
| | 2085 | dTCfaCfgGfgCfgGfaUfgUfcGfuUfgdTsdT |
| | 2086 | dTCfcAfcGfgGfcGfgAfuGfuCfgUfudTsdT |
| | 2087 | dTAfcCfaCfgGfgCfgGfaUfgUfcGfudTsdT |
| | 2088 | dTAfaGfcAfcCfaCfgGfgCfgGfaUfgdTsdT |
| | 2089 | dTGfaAfgCfaCfcAfcGfgGfcGfgAfudTsdT |
| | 2090 | dTAfcGfaAfgCfaCfcAfcGfgGfcGfgdTsdT |
| | 2091 | dTGfcAfcGfaAfgCfaCfcAfcGfgGfcdTsdT |
| | 2092 | dTCfaUfgAfgUfgGfgAfcAfuGfaAfgdTsdT |
| | 2093 | dTUfuCfgGfcGfgUfgCfcGfgCfuGfcdTsdT |
| | 2094 | dTAfcAfgAfcUfcUfuGfcGfgAfgCfcdTsdT |
| | 2095 | dTGfaCfaGfaCfuCfuUfgCfgGfaGfcdTsdT |
| | 2096 | dTGfuCfaUfcGfaAfgAfcAfgAfcUfcdTsdT |
| | 2097 | dTGfgUfcAfuCfgAfaGfaCfaGfaCfudTsdT |
| | 2098 | dTAfcGfcGfgGfuCfaUfcGfaAfgAfcdTsdT |
| | 2099 | dTGfaCfgCfgGfgUfcAfuCfgAfaGfadTsdT |
| | 2100 | dTCfgAfcGfcGfgGfuCfaUfcGfaAfgdTsdT |
| | 2101 | dTAfcGfaCfgCfgGfgUfcAfuCfgAfadTsdT |

TABLE 2-continued

| Modified F12 RNAi trigger antisense strand sequences. | | |
|---|---|---|
| Strand ID | SEQ ID No. | Antisense Sequence (5' → 3') |
| | 2102 | dTAfaCfgAfcGfcGfgGfuCfaUfcGfadTsdT |
| | 2103 | dTCfaAfcGfaCfgCfgGfgUfcAfuCfgdTsdT |
| | 2104 | dTCfcAfaCfgAfcGfcGfgGfuCfaUfcdTsdT |
| | 2105 | dTCfgCfcAfaCfgAfcGfcGfgGfuCfadTsdT |
| | 2106 | dTCfcGfcCfaAfcGfaCfgCfgGfgUfcdTsdT |
| | 2107 | dTCfcGfcGfuAfgCfgCfcAfcCfaGfcdTsdT |
| | 2108 | dTCfcCfcGfcGfuAfgCfgCfcAfcCfadTsdT |
| | 2109 | dTGfcCfcCfgCfgUfaGfcGfcCfaCfcdTsdT |
| | 2110 | dTCfgCfcCfcGfcGfuAfgCfgCfcAfcdTsdT |
| | 2111 | dTGfgGfuGfcGfcCfcCfgCfgUfaGfcdTsdT |
| | 2112 | dTGfcGfaUfgUfaGfgGfgUfgCfgCfcdTsdT |
| | 2113 | dTCfgCfgGfcGfaUfgUfaGfgGfgUfgdTsdT |
| | 2114 | dTAfgCfgCfgGfcGfaUfgUfaGfgGfgdTsdT |
| | 2115 | dTCfaGfcGfcGfgCfgAfuGfuAfgGfgdTsdT |
| | 2116 | dTAfcAfgCfgCfgGfcGfaUfgUfaGfgdTsdT |
| | 2117 | dTUfaCfaGfcGfcGfgCfgAfuGfuAfgdTsdT |
| | 2118 | dTGfuAfcAfgCfgCfgGfcGfaUfgUfadTsdT |
| | 2119 | dTCfaGfuAfcAfgCfgCfgGfcGfaUfgdTsdT |
| | 2120 | dTCfcCfaGfuAfcAfgCfgCfgGfcGfadTsdT |
| | 2121 | dTAfuGfaGfgCfuGfcCfgGfcGfcAfgdTsdT |
| | 2122 | dTCfgUfcAfgAfuCfcUfcGfgGfuGfcdTsdT |
| | 2123 | dTCfcGfuCfaGfaUfcCfuCfgGfgUfgdTsdT |
| | 2124 | dTCfgAfgAfaGfgCfcUfcGfuGfcAfadTsdT |
| | 2125 | dTGfcGfaGfaAfgGfcCfuCfgUfgCfadTsdT |
| | 2126 | dTAfaCfaGfaGfcCfaGfgUfcGfuGfcdTsdT |
| | 2127 | dTCfuGfaAfgGfcGfcAfaCfaGfaGfcdTsdT |
| | 2128 | dTAfuCfcUfcCfuGfaAfgGfcGfcAfadTsdT |
| | 2129 | dTAfgCfgCfgCfaGfcUfgCfcGfuCfcdTsdT |
| | 2130 | dTUfaAfgGfcGfaCfaGfgAfgCfgCfgdTsdT |
| | 2131 | dTGfuAfaGfgCfgAfcAfgGfaGfcGfcdTsdT |
| | 2132 | dTCfgUfaAfgGfcGfaCfaGfgAfgCfgdTsdT |
| | 2133 | dTAfcGfuAfaGfgCfgAfcAfgGfaGfcdTsdT |
| | 2134 | dTAfaCfgUfaAfgGfcGfaCfaGfgAfgdTsdT |
| | 2135 | dTGfaAfcGfuAfaGfgCfgAfcAfgGfadTsdT |
| | 2136 | dTGfcUfgAfaCfgUfaAfgGfcGfaCfadTsdT |
| | 2137 | dTGfgCfuGfaAfcGfuAfaGfgCfgAfcdTsdT |
| | 2138 | dTCfgGfcUfgAfaCfgUfaAfgGfcGfadTsdT |

TABLE 2-continued

Modified F12 RNAi trigger antisense strand sequences.

| Strand ID | SEQ ID No. | Antisense Sequence (5' → 3') |
|---|---|---|
| | 2139 | dTCfcGfgCfuGfaAfcGfuAfaGfgCfgdTsdT |
| | 2140 | dTAfcCfgGfcUfgAfaCfgUfaAfgGfcdTsdT |
| | 2141 | dTAfcAfcCfgGfcUfgAfaCfgUfaAfgdTsdT |
| | 2142 | dTGfgCfaCfaCfcGfgCfuGfaAfcGfudTsdT |
| | 2143 | dTCfcGfcUfuGfgCfaGfgCfaCfaCfcdTsdT |
| | 2144 | dTCfcCfcCfuCfgAfaCfuGfgUfgGfcdTsdT |
| | 2145 | dTCfgCfcCfcCfuCfgAfaCfuGfgUfgdTsdT |
| | 2146 | dTAfuUfcCfuCfcGfcCfcCfcUfcGfadTsdT |
| | 2147 | dTUfcGfaGfgAfaCfcCfuGfcGfcAfgdTsdT |
| | 2148 | dTCfuCfgAfgGfaAfcCfcUfgCfgCfadTsdT |
| | 2149 | dTCfcUfcGfaGfgAfaCfcCfuGfcGfcdTsdT |
| | 2150 | dTGfgUfgCfcGfcCfcUfcGfaGfgAfadTsdT |
| | 2151 | dTAfuCfgGfuGfcCfgCfcCfuCfgAfgdTsdT |
| | 2152 | dTCfaUfcGfgUfgCfcGfcCfcUfcGfadTsdT |
| | 2153 | dTGfgGfuGfaGfcCfgGfcGfcUfcUfgdTsdT |
| | 2154 | dTGfcCfcGfaUfcCfcCfaGfcUfgAfudTsdT |
| | 2155 | dTGfgUfcAfcCfaCfaGfcCfcGfaUfcdTsdT |
| | 2156 | dTAfcGfcCfuGfgCfuUfgUfuGfcGfgdTsdT |
| | 2157 | dTAfgAfcGfcCfuGfgCfuUfgUfuGfcdTsdT |
| | 2158 | dTAfcAfuCfgGfuGfuAfgAfcGfcCfudTsdT |
| | 2159 | dTCfaCfaUfcGfgUfgUfaGfaCfgCfcdTsdT |
| | 2160 | dTCfcAfcAfuCfgGfuGfuAfgAfcGfcdTsdT |
| | 2161 | dTGfuGfuGfcUfcCfcGfgAfuCfcAfgdTsdT |
| | 2162 | dTGfaGfuCfcCfuGfaGfcAfaUfcAfgdTsdT |
| | 2163 | dTGfaUfgAfgUfcCfcUfgAfgCfaAfudTsdT |
| | 2164 | dTGfcAfcUfuUfaUfuGfaGfuUfcCfudTsdT |
| | 2165 | dTAfgCfaCfuUfuAfuUfgAfgUfuCfcdTsdT |

TABLE 3

Modified F12 RNAi trigger sense strand sequences.

| Strand ID | SEQ ID No. | Sense Sequence (5' → 3') |
|---|---|---|
| AM00913-SS | 837 | CfcCfuGfgUfgUfgCfuAfcCfaCfcAf(invdT) |
| AM00914-SS | 838 | CfcUfgGfuGfuGfcUfaCfcAfcCfcAf(invdT) |
| AM00915-SS | 839 | CfuGfgUfgUfgCfuAfcCfaCfcCfcAf(invdT) |
| AM00916-SS | 840 | UfuGfgAfgCfcCfaAfgAfaAfgUfgAf(invdT) |

TABLE 3-continued

Modified F12 RNAi trigger sense strand sequences.

| Strand ID | SEQ ID No. | Sense Sequence (5' → 3') |
|---|---|---|
| AM00917-SS | 841 | UfgGfaGfcCfcAfaGfaAfaGfuGfaAf(invdT) |
| AM00918-SS | 842 | GfgAfgCfcCfaAfgAfaAfgUfgAfaAf(invdT) |
| AM00919-SS | 843 | GfaGfcCfcAfaGfaAfaGfuGfaAfaAf(invdT) |
| AM00920-SS | 844 | AfgCfcCfaAfgAfaAfgUfgAfaAfgAf(invdT) |
| AM00921-SS | 845 | GfcCfcAfaGfaAfaGfuGfaAfaGfaAf(invdT) |
| AM00922-SS | 846 | CfcCfaAfgAfaAfgUfgAfaAfgAfcAf(invdT) |
| AM00923-SS | 847 | CfcAfaGfaAfaGfuGfaAfaGfaCfcAf(invdT) |
| AM00924-SS | 848 | CfaAfgAfaAfgUfgAfaAfgAfcCfaAf(invdT) |
| AM00925-SS | 849 | GfuGfcUfuUfgAfgCfcUfcAfgCfuAf(invdT) |
| AM00926-SS | 850 | UfgCfuUfuGfaGfcCfuCfaGfcUfuAf(invdT) |
| AM00927-SS | 851 | GfcUfuUfgAfgCfcUfcAfgCfuUfcAf(invdT) |
| AM00928-SS | 852 | UfuUfgAfgCfcUfcAfgCfuUfcUfcAf(invdT) |
| AM00929-SS | 853 | CfuGfgCfcAfgCfcAfgGfcCfuGfcAf(invdT) |
| AM00930-SS | 854 | CfcAfcCfaGfuUfcGfaGfgGfgGfcAf(invdT) |
| AM00931-SS | 855 | GfgGfcUfgUfgGfuGfaCfcGfcAfaAf(invdT) |
| AM00932-SS | 856 | GfgCfuGfuGfgUfgAfcCfgCfaAfcAf(invdT) |
| AM00933-SS | 857 | GfcUfgUfgGfuGfaCfcGfcAfaCfaAf(invdT) |
| AM00934-SS | 858 | CfuGfuGfgUfgAfcCfgCfaAfcAfaAf(invdT) |
| AM00935-SS | 859 | UfgUfgGfuGfaCfcGfcAfaCfaAfgAf(invdT) |
| AM00936-SS | 860 | GfuGfgUfgAfcCfgCfaAfcAfaGfcAf(invdT) |
| AM00937-SS | 861 | UfgGfuGfaCfcGfcAfaCfaAfgCfcAf(invdT) |
| AM00938-SS | 862 | GfaAfcUfcAfaUfaAfaGfuGfcUfuAf(invdT) |
| AM00939-SS | 863 | AfaCfuCfaAfuAfaAfgUfgCfuUfuAf(invdT) |
| AM00940-SS | 864 | AfcUfcAfaUfaAfaGfuGfcUfuUfgAf(invdT) |
| AM00941-SS | 865 | CfuCfaAfuAfaAfgUfgCfuUfuGfaAf(invdT) |
| AM00942-SS | 866 | UfcAfaUfaAfaGfuGfcUfuUfgAfaAf(invdT) |
| AM00943-SS | 867 | CfaAfuAfaAFgUfgCfuUfuGfaAfaAf(invdT) |
| AM00944-SS | 868 | AfaUfaAfaGfuGfcUfuUfgAfaAfaAf(invdT) |
| AM01307-SS | 869 | UfgGfaCfcAfaCfgGfaCfgGfaUfgAf(invdT) |
| AM01308-SS | 870 | GfgAfcCfaAfcGfgAfcGfgAfuGfcAf(invdT) |
| AM01309-SS | 871 | GfaCfcAfaCfgGfaCfgGfaUfgCfcAf(invdT) |
| AM01310-SS | 872 | AfcCfaAfcGfgAfcGfgAfuGfcCfaAf(invdT) |
| AM01311-SS | 873 | CfcAfaCfgGfaCfgGfaUfgCfcAfuAf(invdT) |
| AM01312-SS | 874 | CfaAfcGfgAfcGfgAfuGfcCfaUfgAf(invdT) |
| AM01313-SS | 875 | AfaCfgGfaCfgGfaUfgCfcAfuGfaAf(invdT) |
| AM01314-SS | 876 | AfcGfgAfcGfgAfuGfcCfaUfgAfgAf(invdT) |
| AM01315-SS | 877 | GfaUfgCfcAfuGfaGfgGfcUfcUfgAf(invdT) |

TABLE 3-continued

Modified F12 RNAi trigger sense strand sequences.

| Strand ID | SEQ ID No. | Sense Sequence (5' → 3') |
|---|---|---|
| AM01316-SS | 878 | AfuGfcCfaUfgAfgGfgCfuCfuGfcAf(invdT) |
| AM01317-SS | 879 | CfuCfuGfcUfgCfuCfcUfgGfgGfuAf(invdT) |
| AM01318-SS | 880 | GfgAfgCfcCfuGfcCfaCfuUfcCfcAf(invdT) |
| AM01319-SS | 881 | CfcAfcCfgGfcAfgCfuGfuAfcCfaAf(invdT) |
| AM01320-SS | 882 | AfaCfuUfuGfaUfcAfgGfaCfcAfgAf(invdT) |
| AM01321-SS | 883 | AfcUfuUfgAfuCfaGfgAfcCfaGfcAf(invdT) |
| AM01322-SS | 884 | UfuUfgAfuCfaGfgAfcCfaGfcGfaAf(invdT) |
| AM01323-SS | 885 | GfaUfcAfgGfaCfcAfgCfgAfuGfgAf(invdT) |
| AM01324-SS | 886 | AfuCfaGfgAfcCfaGfcGfaUfgGfgAf(invdT) |
| AM01325-SS | 887 | CfaGfgAfcCfaGfcGfaUfgGfgAf(invdT) |
| AM01326-SS | 888 | GfuUfuGfgAfgCfcCfaAfgAfaAfgAf(invdT) |
| AM01327-Ss | 889 | UfuUfgGfaGfcCfcAfaGfaAfaGfuAf(invdT) |
| AM01328-SS | 890 | UfgAfuGfgCfcGfcGfgGfcUfcAfgAf(invdT) |
| AM01329-SS | 891 | UfcAfgCfcGfuGfgGfcCfuCfgGfaAf(invdT) |
| AM01330-SS | 892 | CfaGfcCfgUfgGfgCfcUfcGfgAfgAf(invdT) |
| AM01331-SS | 893 | AfgCfcGfuGfgGfcCfuCfgGfaGfgAf(invdT) |
| AM01332-SS | 894 | UfgGfgCfcUfcGfgAfgGfcCfaCfcAf(invdT) |
| AM01333-SS | 895 | GfgGfcCfuCfgGfaGfgCfcAfcCfuAf(invdT) |
| AM01334-SS | 896 | GfgCfcUfcGfgAfgGfcCfaCfcUfaAf(invdT) |
| AM01335-SS | 897 | GfcCfuCfgGfaGfgCfcAfcCfuAfcAf(invdT) |
| AM01336-SS | 898 | AfaGfcGfcGfgAfaCfuGfgGfgAfcAf(invdT) |
| AM01337-SS | 899 | CfcAfcGfcCfuUfcUfgCfcGfgAfaAf(invdT) |
| AM01338-SS | 900 | CfaCfgCfcUfuCfuGfcCfgGfaAfcAf(invdT) |
| AM01339-SS | 901 | AfcGfcCfuUfcUfgCfcGfgAfaCfcAf(invdT) |
| AM01340-SS | 902 | CfcUfuCfuGfcCfgGfaAfcCfcGfgAf(invdT) |
| AM01341-SS | 903 | CfuUfcU£gCfcGfgAfaCfcCfgGfaAf(invdT) |
| AM01342-SS | 904 | UfuCfuGfcCfgGfaAfcCfcGfgAfcAf(invdT) |
| AM01343-SS | 905 | UfcUfgCfcGfgAfaCfcCfgGfaCfaAf(invdT) |
| AM01344-SS | 906 | GfcCfgGfaAfcCfcGfgAfcAfaCfgAf(invdT) |
| AM01345-SS | 907 | CfcGfgAfaCfcCfgGfaCfaAfcGfaAf(invdT) |
| AM01346-SS | 908 | GfcCfuUfcCfcUfgAfcCfaGfgAfaAf(invdT) |
| AM01347-SS | 909 | CfcUfuCfcCfuGfaCfcAfgGfaAfcAf(invdT) |
| AM01348-SS | 910 | CfuUfcCfcUfgAfcCfaGfgAfaCfgAf(invdT) |
| AM01349-SS | 911 | UfuCfcCfuGfaCfcAfgGfaAfcGfgAf(invdT) |
| AM01350-SS | 912 | UfcCfcUfgAfcCfaGfgAfaCfgGfcAf(invdT) |
| AM01351-SS | 913 | AfcCfaGfgAfaCfgGfcCfcAfcUfgAf(invdT) |
| AM01352-SS | 914 | GfgAfaCfgGfcCfcAfcUfgAfgCfuAf(invdT) |

TABLE 3-continued

Modified F12 RNAi trigger sense strand sequences.

| Strand ID | SEQ ID No. | Sense Sequence (5' → 3') |
|---|---|---|
| AM01353-SS | 915 | CfcGfcAfaGfaGfuCfuGfuCfuUfcAf(invdT) |
| AM01354-SS | 916 | AfcAfgUfuUfcUfgCfgCfcGfgCfaAf(invdT) |
| AM01355-SS | 917 | GfcCfgGfcAfgCfcUfcAfuCfgCfcAf(invdT) |
| AM01356-SS | 918 | CfcGfgCfaGfcCfuCfaUfcGfcCfcAf(invdT) |
| AM01357-SS | 919 | CfgGfcAfgCfcUfcAfuCfgCfcCfcAf(invdT) |
| AM01358-SS | 920 | CfaUfcGfcCfcCfcUfgCfuGfgGfuAf(invdT) |
| AM01359-SS | 921 | UfcGfcCfcCfcUfgCfuGfgGfuGfcAf(invdT) |
| AM01360-SS | 922 | CfgCfcCfcCfuGfcUfgGfgUfgCfuAf(invdT) |
| AM01361-SS | 923 | CfcCfcCfuGfcUfgGfgUfgCfuGfaAf(invdT) |
| AM01362-SS | 924 | UfcUfgAfcGfgUfgGfuGfcUfcGfgAf(invdT) |
| AM01363-SS | 925 | UfgAfcGfgUfgGfuGfcUfcGfgCfcAf(invdT) |
| AM01364-SS | 926 | GfaCfgGfuGfgUfgCfuCfgGfcCfaAf(invdT) |
| AM01365-SS | 927 | GfgUfgGfuGfcUfcGfgCfcAfgGfaAf(invdT) |
| AM01366-SS | 928 | GfgAfuGfcGfgAfcGfgCfaGfcUfgAf(invdT) |
| AM01367-SS | 929 | AfcGfgCfaGfcUfgCfgCfgCfuCfcAf(invdT) |
| AM01368-SS | 930 | GfcUfcCfuGfuCfgCfcUfuAfcGfuAf(invdT) |
| AM01369-SS | 931 | CfuGfuCfgCfcUfuAfcGfuUfcAfgAf(invdT) |
| AM01370-SS | 932 | GfgCfgGfaGfgAfaUfaUfgCfcAfgAf(invdT) |
| AM01371-SS | 933 | CfgGfaGfgAfaUfaUfgCfcAfgCfuAf(invdT) |
| AM01372-SS | 934 | GfaGfgAfaUfaUfgCfcAfgCfuUfcAf(invdT) |
| AM01373-SS | 935 | AfgGfaAfuAfuGfcCfaGfcUfuCfcAf(invdT) |
| AM01374-SS | 936 | GfgUfgAfuUfcCfgGfaGfcCfcCfgAf(invdT) |
| AM01375-SS | 937 | CfcGfcAfgUfgAfgAfgAfgUfgGfcAf(invdT) |
| AM01376-SS | 938 | CfgCfaGfuGfaGfaGfaGfuGfgCfuAf(invdT) |
| AM01471-SS | 939 | CfgCfcAfuGfaCfgGfcUfcUfgUfuAf(invdT) |
| AM01472-SS | 940 | GfcCfaUfgAfcGfgCfuCfuGfuUfgAf(invdT) |
| AM01473-SS | 941 | CfcAfuGfaCfgGfcUfcUfgUfuGfuAf(invdT) |
| AM01474-SS | 942 | CfaUfgAfcGfgCfuCfuGfuUfgUfuAf(invdT) |
| AM01475-SS | 943 | AfuGfaCfgGfcUfcUfgUfuGfuUfcAf(invdT) |
| AM01476-SS | 944 | UfgAfcGfgCfuCfuGfuUfgUfuCfcAf(invdT) |
| AM01477-SS | 945 | UfcCfcUfuUfcAfgUfaCfcAfcCfgAf(invdT) |
| AM01478-SS | 946 | CfcAfcAfaAfuGfcAfuCfcAfcAfaAf(invdT) |
| AM01479-SS | 947 | CfaAfuGfgGfaAfuAfcUfgCfuUfgAf(invdT) |
| AM01480-SS | 948 | UfgGfgGfaUfaCfuGfcUfuGfgAfgAf(invdT) |
| AM01481-SS | 949 | GfgGfgAfuAfcUfgCfuUfgGfaGfcAf(invdT) |
| AM01482-SS | 950 | GfgAfuAfcUfgCfuUfgGfaGfcCfcAf(invdT) |
| AM01483-SS | 951 | GfaCfcAfuUfgCfaGfcAfaAfcAfcAf(invdT) |

TABLE 3-continued

Modified F12 RNAi trigger sense strand sequences.

| Strand ID | SEQ ID No. | Sense Sequence (5' → 3') |
|---|---|---|
| AM01484-SS | 952 | GfgAfgGfcCfaCfcUfaCfcGfgAfaAf(invdT) |
| AM01485-SS | 953 | GfaGfgCfcAfcCfuAfcCfgGfaAfcAf(invdT) |
| AM01486-SS | 954 | AfgGfcCfaCfcUfaCfcGfgAfaCfaAf(invdT) |
| AM01487-SS | 955 | UfaCfcGfgAfaCfaUfgAfcUfgAfgAf(invdT) |
| AM01488-SS | 956 | CfaGfaUfaAfuGfaCfaCfaCfgUfcAf(invdT) |
| AM01489-SS | 957 | AfgAfuAfaUfgAfcAfcAfcGfuCfcAf(invdT) |
| AM01490-SS | 958 | GfaUfaAfuGfaCfaCfaCfgUfcCfaAf(invdT) |
| AM01491-SS | 959 | AfuAfaUfgAfcAfcAfcGfuCfcAfuAf(invdT) |
| AM01492-SS | 960 | AfuGfaCfaCfaCfgUfcCfaUfgGfuAf(invdT) |
| AM01493-SS | 961 | GfcGfcGfuGfgUfgGfgCfgGfaCfuAf(invdT) |
| AM01494-SS | 962 | CfgCfgUfgGfuGfgGfcGfgAfcUfaAf(invdT) |
| AM01495-SS | 963 | GfcGfuGfgUfgGfgCfgGfaCfuAfgAf(invdT) |
| AM01496-SS | 964 | CfgUfgGfuGfgGfcGfgAfcUfaGfuAf(invdT) |
| AM01497-SS | 965 | GfgCfgGfaCfuAfgUfgGfcUfcUfgAf(invdT) |
| AM01498-SS | 966 | GfgCfcAfgCfgCfcCfgAfgGfaAfcAf(invdT) |
| AM01499-SS | 967 | GfgAfaCfuGfaCfaGfuGfgUfaCfuAf(invdT) |
| AM01500-SS | 968 | AfgUfgGfuAfcUfuGfgUfcAfaGfaAf(invdT) |
| AM01501-SS | 969 | UfgGfuAfcUfuGfgUfcAfaGfaUfcAf(invdT) |
| AM01502-SS | 970 | GfgUfaCfuUfgGfuCfaAfgAfuCfgAf(invdT) |
| AM01503-SS | 971 | UfaCfuUfgGfuCfaAfgAfuCfgCfcAf(invdT) |
| AM01504-SS | 972 | CfuCfcUfaCfcGfcCfuUfcAfcGfaAf(invdT) |
| AM01505-SS | 973 | CfcUfaCfcGfcCfuUfcAfcGfaGfaAf(invdT) |
| AM01506-SS | 974 | CfuAfcCfgCfcUfuCfaCfgAfgGfaAf(invdT) |
| AM01507-SS | 975 | CfuGfaGfaCfaGfuGfcUfcUfgCfgAf(invdT) |
| AM01508-SS | 976 | AfgUfuCfgAfgGfgGfcCfuGfaAfgAf(invdT) |
| AM01509-SS | 977 | GfuUfcGfaGfgGfgGfcUfgAfaGfaAf(invdT) |
| AM01510-SS | 978 | UfcGfaGfgGfgGfcUfgAfaGfaAfuAf(invdT) |
| AM01511-SS | 979 | CfuCfuAfaCfgUfgCfaCfgGfaGfaAf(invdT) |
| AM01512-SS | 980 | CfuAfaCfgUfgCfaCfgGfaGfaCfgAf(invdT) |
| AM01513-SS | 981 | AfcGfuGfcAfcGfgAfgAfcGfcCfaAf(invdT) |
| AM01613-SS | 982 | (Chol-TEG)uAuAfgCfcCfaAfgAfaAfgUfgAfaAfgAf(invdT) |
| AM01614-SS | 983 | AfgCfcCfaAfgAfaAfgUfgAfaAfgUf(invdT) |
| AM01615-SS | 984 | (Chol-TEG)uAuGfcCfcAfaGfaAfaGfuGfaAfaGfaAf(invdT) |
| AM01616-SS | 985 | (Chol-TEG)uAuCfcCfaAfgAfaAfgUfgAfaAfgAfcAf(invdT) |
| AM01617-SS | 986 | (Chol-TEG)uAuCfcAfaGfaAfaGfuGfaAfaGfaCfcAf(invdT) |
| AM01618-SS | 987 | CfcAfaGfaAfaGfuGfaAfaGfaCfcUf(invdT) |
| AM01619-SS | 988 | (Chol-TEG)uAuCfaAfgAfaAfgUfgAfaAfgAfcCfaAf(invdT) |

TABLE 3-continued

Modified F12 RNAi trigger sense strand sequences.

| Strand ID | SEQ ID No. | Sense Sequence (5' → 3') |
|---|---|---|
| AM01620-SS | 989 | (Chol-TEG)uAuUfuUfgAfgCfcUfcAfgCfuUfcUfcAf(invdT) |
| AM01905-SS | 990 | (Chol-TEG)uAuCfcCfaAfgAfaAfgUfgAfaAfgAfscsAf(invdT) |
| AM01908-SS | 991 | (Chol-TEG)uAuCfcAfaGfaAfAfGfuGfaAfaGfaCfscsAf(invdT) |
| AM01911-SS | 992 | (Chol-TEG)uAuUfuUfgAfgCfcUfcAfgCfuUfcUfscsAf(invdT) |
| AM01922-SS | 993 | (Chol-TEG)uAuCfcCfaAfgAfAfAfgUfgAfaAfgAfscsAf(invdT) |
| AM01924-SS | 994 | (Chol-TEG)uAuCfcAfaGfaAfAfGfuGfaAfaGfaCfscsAf(invdT) |
| AM01926-SS | 995 | (Chol-TEG)uAuUfuUfgAfgCfCfUfcAfgCfuUfcUfscsAf(invdT) |
| AM01932-SS | 996 | GfscsCfcAfaGfaAfAfGfuGfaAfaGfaCfcAfXuAu(TEG-Chol) |
| AM01995-SS | 997 | (Chol-TEG)uAuCfcAfaGfaAfAfGfuGfaAfaGfaCfcAf(invdT) |
| AM02061-SS | 998 | (Chol-TEG)uAuCfcCfaAfgAfAfAfgUfgAfaAfgAfcAf(invdT) |
| AM02063-SS | 999 | (Chol-TEG)uAuUfuUfgAfgCfCfUfcAfgCfuUfcUfcAf(invdT) |
| AM02084-SS | 1000 | (Alk-SS-C6)CfcAfaGfaAfaAfGfuGfaAfaGfaCfcAf(invdT) |
| AM02085-SS | 1001 | (NH2-C6)CfcAfaGfaAfaAfGfuGfaAfaGfaCfcAf(invdT) |
| AM02168-SS | 1002 | uAuAusGfscCfcAfaGfaAfAfGfuGfaAfaGfaCfcAf(C6-SS-C6)(TEG-Chol) |
| AM02169-SS | 1003 | (Chol-TEG)uAuAusGfscCfcAfaGfaAfAfGfuGfaAfaGfaCfscsAf |
| AM02173-SS | 1004 | usGfscCfcAfaGfaAfAfGfuGfaAfaGfaCfcAf(C6-SS-C6)(TEG-Chol) |
| AM02174-SS | 1005 | GfscsCfcAfaGfaAfAfGfuGfaAfaGfaCfcAf(C6-SS-C6)(TEG-Chol) |
| AM02196-SS | 1006 | (Chol-TEG)uAuAusGfscCfcAfaGfaAfAfGfuGfaAfaGfaCfc(invdA) |
| AM02202-SS | 1007 | GfsgsAfgCfcCfaAfgGfAfaAfgUfgAfaAfgAf(C6-NH2) |
| AM02203-SS | 1008 | GfsasGfcCfcAfaGfAfAfaGfuGfaAfaGfaAf(C6-NH2) |
| AM02204-SS | 1009 | AfsgsCfcCfaAfgAfAfAfgUfgAfaAfgAfcAf(C6-NH2) |
| AM02205-SS | 1010 | GfscsCfcAfaGfaAfAfGfuGfaAfaGfaCfcAf(C6-NH2) |
| AM02206-SS | 1011 | CfscsCfaAfgAfaAfGfUfgAfaAfgAfcCfaAf(C6-NH2) |
| AM02207-SS | 1012 | GfscsUfuUfgAfgCfCfUfcAfgCfuUfcUfcAf(C6-NH2) |
| AM02209-SS | 1013 | uAuAuGfscsCfcAfaGfaAfAfGfuGfaAfaGfaCfcAf(C6-NH2) |
| AM02269-SS | 1014 | GfsgsAfgCfcCfaAfgGfAfaAfgUfgAfaAfgAf(C6-SS-Alk-Me) |
| AM02270-SS | 1015 | GfsasGfcCfcAfaGfAfAfaGfuGfaAfaGfaAf(C6-SS-Alk-Me) |
| AM02271-SS | 1016 | AfsgsCfcCfaAfgAfAfAfgUfgAfaAfgAfcAf(C6-SS-Alk-Me) |
| AM02272-SS | 1017 | GfscsCfcAfaGfaAfAfGfuGfaAfaGfaCfcAf(C6-SS-Alk-Me) |
| AM02273-SS | 1018 | CfscsCfaAfgAfaAfGfUfgAfaAfgAfcCfaAf(C6-SS-Alk-Me) |
| AM02274-SS | 1019 | GfscsUfuUfgAfgCfCfUfcAfgCfuUfcUfcAf(C6-SS-Alk-Me) |
| AM02275-SS | 1020 | uAuAuGfscsCfcAfaGfaAfAfGfuGfaAfaGfaCfcAf(C6-SS-Alk-Me) |
| AM02328-SS | 1021 | uAuAuGfscsCfcAfaGfaAfAfGfuGfaAfaGfaCfcAf(NAG3) |
| AM02329-SS | 1022 | uAuAuGfscsCfcAfaGfaAfAfGfuGfaAfaGfaCfcAf(C11-NAG3) |
| AM02330-SS | 1023 | (Chol-TEG)uAuAusGfscCfcAfaGfaAfAfGfuGfaAfaGfaCfscsAf |
| AM02351-SS | 1024 | (Chol-TEG)uAuAusGfscCfcAfaGfaaAfGfuGfaAfaGfaCfscsAf |

TABLE 3-continued

Modified F12 RNAi trigger sense strand sequences.

| Strand ID | SEQ ID No. | Sense Sequence (5' → 3') |
|---|---|---|
| AM02352-SS1025 | | (Chol-TEG)uAuAusGfscCfcAfaGfAfaAfGfuGfaAfaGfaCfscsAf |
| AM02353-SS1026 | | (Chol-TEG)uAuAusgsCfcCfaAfgAfaAfGfuGfaAfaGfaCfscsAf |
| AM02355-SS1027 | | (Chol-TEG)uAuAusGfscCfcAfaGfaAfaGfuGfAUNAAfaGfaCfscsAf |
| AM02356-SS1028 | | (Chol-TEG)uAuAusGfscCfcAfaGfaAfaGfuGUNAaAfaGfaCfscsAf |
| AM02357-SS1029 | | (Chol-TEG)uAuAusGfscCfcAfaGfaAfaGfUUNAGfaAfaGfaCfscsAf |
| AM02358-SS1030 | | (Chol-TEG)uAuAusGfscCfcAfaGfaAfaGUNAuGfaAfaGfaCfscsAf |
| AM02359-SS1031 | | (Chol-TEG)uAuAusGfscCfcAfaGfaAfAUNAGfuGfaAfaGfaCfscsAf |
| AM02360-SS1032 | | (Chol-TEG)uAuAusGfscCfcAfaGfaAUNAaGfuGfaAfaGfaCfscsAf |
| AM02361-SS1033 | | (Chol-TEG)uAuAusGfscCfcAfaGfAUNAAfaGfuGfaAfaGfaCfscsAf |
| AM02362-SS1034 | | (Chol-TEG)uAuAusGfscCfcAfaGUNAaAfaGfuGfaAfaGfaCfscsAf |
| AM02399-SS1035 | | (Chol-TEG)uAuAusGfscUfuUfgAfgCfcUfcAfgCfuUfcUfscsAf |
| AM02400-SS1036 | | (Chol-TEG)uAuAusGfscUfuUfgAfgcCfUfcAfgCfuUfcUfscsAf |
| AM02401-SS1037 | | (Chol-TEG)uAuAusGfscUfuUfgAfGfcCfUfcAfgCfuUfcUfscsAf |
| AM02402-SS1038 | | (Chol-TEG)uAuAusgsCfuUfuGfaGfCfcUfcAfgCfuUfcUfscsAf |
| AM02403-SS1039 | | (NAG4)uAuAuGfscsCfcAfaGfaAfAfGfuGfaAfaGfaCfc(invdA) |
| AM02431-SS1040 | | (Chol-TEG)uAuAusGfscCfcAfaGfaAfaGfuGfaAfaGfaCfc(invdA) |
| AM02435-SS1041 | | (Chol-TEG)uAusasuGfaGfcCfcAfaGfaAfaGfuGfaAfaGfaCfc(invdA) |
| AM02436-SS1042 | | (Chol-TEG)uAuAusGfscUfuUfgAfgCfcUfcAfgCfuUfcUfc(invdA) |
| AM02440-SS1043 | | (Chol-TEG)uAusasuGfuGfcUfuUfgAfgCfcUfcAfgCfuUfcUfc(invdA) |

TABLE 3-continued

Modified F12 RNAi trigger sense strand sequences.

| Strand ID | SEQ ID No. | Sense Sequence (5' → 3') |
|---|---|---|
| AM02498-SS1062 | | (Chol-TEG)uAuAusGfcCfcAfagAfAfaGfuGfaAfaGfaCfc(invdA) |
| AM02499-SS1063 | | (Chol-TEG)uAuAuGfcCfcAfagAfAfaGfuGfaAfaGfaCfc(invdA) |
| AM02500-SS1064 | | (Chol-TEG)uAuAusGfcCfcAfAfgaAfaGfuGfaAfaGfaCfc(invdA) |
| AM02501-SS1065 | | (Chol-TEG)uAuAuGfcCfcAfAfgaAfaGfuGfaAfaGfaCfc(invdA) |
| AM02513-SS1066 | | uAuAusGfsuUfuGfgAfgCfcCfaAfgAfaAfgUfgAf(C6-SS-Alk-Me) |
| AM02514-SS1067 | | uAuAusUfsuUfgGfaGfcCfcAfaGfaAfaGfuGfaAf(C6-SS-Alk-Me) |
| AM02515-SS1068 | | uAuAusUfsuGfgAfgCfcCfaAfgAfaAfgUfgAfaAf(C6-SS-Alk-Me) |
| AM02516-SS1069 | | uAuAusUfsgGfaGfcCfcAfaGfaAfaGfuGfaAfaAf(C6-SS-Alk-Me) |
| AM02517-SS1070 | | uAuAusAfsaGfuGfcUfuUfgAfgCfcUfcAfgCfuAf(C6-SS-Alk-Me) |
| AM02518-SS1071 | | uAuAusGfsuGfcUfuUfgAfgCfcUfcAfgCfuUfcAf(C6-SS-Alk-Me) |
| AM02519-SS1072 | | uAuAusGfsgCfuUfuGfuGfgUfgAfcCfgCfaAfcAfaAf(C6-SS-Alk-Me) |
| AM02520-SS1073 | | uAuAusCfsuGfuGfgUfgAfcCfgCfaAfcAfaGfcAf(C6-SS-Alk-Me) |
| AM02521-SS1074 | | uAuAusUfsgUfgGfuGfaCfcGfcAfcAfaGfcGfcAf(C6-SS-Alk-Me) |
| AM02530-SS1075 | | (NH2-C6)GfcCfcAfaGfaAfAfGfuGfaAfaGfaCfcAf(C11-PEG3-NAG3) |
| AM02545-SS1076 | | (Chol-TEG)uAuAuGfscCfcAfaGfaAfaGfuGfaAfaGfaCfc(invdA) |
| AM02550-SS1077 | | (Me-Alk-SS-C6)GfcCfcAfaGfaAfAfGfuGfaAfaGfaCfcAf(C11-PEG3-NAG3) |
| AM02553-SS1078 | | (Chol-TEG)uAuAusGfcCfcAfaGfaAtAUNAGfuGfaAfaGfaCfc(invdA) |
| AM02554-SS1079 | | (Chol-TEG)uAuAusGfcCfcAfaGfaAUNAaGfuGfaAfaGfaCfc(invdA) |
| AM02555-SS1080 | | (Chol-TEG)uAuAusGfcCfcAfaGfAUNAAfaGfuGfaAfaGfaCfc(invdA) |
| AM02556-SS1081 | | (Chol-TEG)uAuAusGfcCfcAfaGUNAaAfaGfuGfaAfaGfaCfc(invdA) |
| AM02580-SS1082 | | AfsgsCfcCfaAfgAfaAfgUfgAfaAfgAfcAf(C6-NH2) |
| AM02581-SS1083 | | AfsgsCfcCfaAfgAfaAfgUfgAfaAfgAfcAf(C6-SS-Alk-Me) |
| AM02583-SS1084 | | CfscsCfaAfgAfaagUfgAfaAfgAfcCfaAf(C6-NH2) |
| AM02584-SS1085 | | CfscsCfaAfgAfaagUfgAfaAfgAfcCfaAf(C6-SS-Alk-Me) |
| AM02634-SS1086 | | (Chol-TEG)UAUUAGfscCfcAfaGfaaAfGfuGfaAfaGfaCfc(invdA) |
| AM02635-SS1087 | | (Chol-TEG)UfaUfaAGfscCfcAfaGfaaAfGfuGfaAfaGfaCfc(invdA) |
| AM02636-SS1088 | | (Chol-TEG)uauaAGfscCfcAfaGfaaAfGfuGfaAfaGfaCfc(invdA) |
| AM02637-SS1089 | | (Chol-TEG)AUAUUGfscCfcAfaGfaaAfGfuGfaAfaGfaCfc(invdA) |
| AM02638-SS1090 | | (Chol-TEG)AfuAfuUGfscCfcAfaGfaaAfGfuGfaAfaGfaCfc(invdA) |
| AM02639-SS1091 | | (Chol-TEG)auauUGfscCfcAfaGfaaAfGfuGfaAfaGfaCfc(invdA) |
| AM02649-SS1092 | | CfcAfaGfaAfaGfuGfaAfaGfaCfcAfuAu(TEG-Chol) |
| AM02651-SS1093 | | gscsCfcAfagaAfAfGfugaAfagaCfcAf(C6-NH2) |
| AM02652-SS1094 | | gscsCfcAfagaAfAfGfugaAfagaCfcAf(C6-SS-Alk-Me) |
| AM02653-SS1095 | | uAuAuGfscsCfcAfaGfaAfAfGfuGfaAfaGfaCfcAf(C11-PEG3-NAG3) |
| AM02654-SS1096 | | (DBCO-TEG)uAuAuGfscsCfcAfaGfaAfAfGfuGfaAfaGfaCfcAf(C11-PEG3-NAG3) |
| AM02655-SS1097 | | uAuAusGfsuGfcUfuUfgAfgCfcUfcAfgCfuUfcAf(C11-PEG3-NAG3) |

TABLE 3-continued

Modified F12 RNAi trigger sense strand sequences.

| Strand ID | SEQ ID No. | Sense Sequence (5' → 3') |
|---|---|---|
| AM02663-SS1098 | | uAuAusgsuGfcUfuUfgAfgCfcUfcAfgCfuUfcAf(C11-PEG3-NAG3) |
| AM02664-SS1099 | | uAuAusGfsugcUfuUfgAfgCfcUfcAfgCfuUfcAf(C11-PEG3-NAG3) |
| AM02665-SS1100 | | uAuAusgsugcUfuUfgAfgCfcUfcAfgCfuUfcAf(C11-PEG3-NAG3) |
| AM02666-SS1101 | | (DBCO-TEG)uAuAusgsugcUfuUfgAfgCfcUfcAfgCfuUfcAf(C11-PEG3-NAG3) |
| AM02723-SS1102 | | usGfsgAfgCfcCfaAfgAfaAfgUfg(invdA) |
| AM02724-SS1103 | | gsGfsaGfcCfcAfaGfaAfaGfuGfa(invdA) |
| AM02725-SS1104 | | gsAfsgCfcCfaAfgAfaAfgUfgAfa(invdA) |
| AM02726-SS1105 | | asGfscCfcAfaGfaAfaGfuGfaAfa(invdA) |
| AM02727-SS1106 | | gsCfscCfaAfgAfaAfgUfgAfaAfg(invdA) |
|

TABLE 3-continued

Modified F12 RNAi trigger sense strand sequences.

| Strand ID | SEQ ID No. | Sense Sequence (5' → 3') |
|---|---|---|
| AM02842-SS1134 | | (NH2-C6)uAuAuGfscsCfcAfaGfaAfAfGfuGfaAfaGfaCfcAf(C11-PEG3-NAG3) |
| AM02843-SS1135 | | (NH2-C6)uAuAusgsugcUfuUfgAfgCfcUfcAfgCfuUfcAf(C11-PEG3-NAG3) |
| AM02844-SS1136 | | (Alk-C6)uAuAuGfscsCfcAfaGfaAfAfGfuGfaAfaGfaCfcAf(C11-PEG3-NAG3) |
| AM02845-SS1137 | | (Alk-C6)uAuAusgsugcUfuUfgAfgCfcUfcAfgCfuUfcAf(C11-PEG3-NAG3) |
| AM02867-SS1138 | | (Spermine)uAuAusGfsuGfcUfuUfgAfgCfcUfcAfgCfuUfcAf(C11-PEG3-NAG3) |
| AM02868-SS1139 | | (Spermine)(Spermine)uAuAusGfsuGfcUfuUfgAfgCfcUfcAfgCfuUfcAf(C11-PEG3-NAG3) |
| AM02869-SS1140 | | (Spermine)(Spermine)(Spermine)uAuAusGfsuGfcUfuUfgAfgCfcUfcAfgCfuUfcAf(C11-PEG3-NAG3) |
| AM02872-SS1141 | | uAuAusGfcCfcAfAfgaAfaAfuGfuGfaAfaGfaCfc(invdA) |
| AM02954-SS1142 | | uAuAugscsCfcAfagaAfAfGfugaAfagaCfcAf(C6-NH2) |
| AM02955-SS1143 | | uAuAugscsCfcAfagaAfAfGfugaAfagaCfcAf(C6-SS-Alk-Me) |
| AM02956-SS1144 | | uAuAugscsCfcAfagaAfAfGfugaAfagaCfcAf(C11-PEG3-NAG3) |
| AM02960-SS1145 | | uAuAugscsccaagaaAfGfugaaagacca(C11-PEG3-NAG3) |
| AM02961-SS1146 | | uAuAugscsccaagaAfaGfugaaagacca(C11-PEG3-NAG3) |
| AM02974-SS1147 | | (Stearyl)uAuAuGfscsCfcAfaGfaAfAfGfuGfaAfaGfaCfcAf(C11-PEG3-NAG3) |
| AM03028-SS1148 | | (Chol-TEG)AuAusGfcCfcAfAfgaAfaAfGfuGfaAfaGfaCfc(invdA) |
| AM03029-SS1149 | | (Chol-TEG)uAusGfcCfcAfAfgaAfaAfGfuGfaAfaGfaCfc(invdA) |
| AM03031-SS1150 | | (BCN)uAuAuGfscsCfcAfaGfaAfAfGfuGfaAfaGfaCfcAf(C11-PEG3-NAG3) |
| AM03032-SS1151 | | uaUfauGfscsCfcAfaGfaAfAfGfuGfaAfaGfaCfcAf(C11-PEG3-NAG3) |
| AM03033-SS1152 | | (Me-Alk-SS-C6)uaUfauGfscsCfcAfaGfaAfAfGfuGfaAfaGfaCfcAf(C11-PEG3-NAG3) |
| AM03034-SS1153 | | (NH2-C6)uaUfauGfscsCfcAfaGfaAfAfGfuGfaAfaGfaCfcAf(C11-PEG3-NAG3) |
| AM03035-SS1154 | | AuGfscsCfcAfaGfaAfAfGfuGfaAfaGfaCfcAf(C11-PEG3-NAG3) |
| AM03044-SS1155 | | (Norbornene-C6)uAuAuGfscsCfcAfaGfaAfAfGfuGfaAfaGfaCfcAf(C11-PEG3-NAG3) |
| AM03045-SS1156 | | (Alk-BC9-C6)uAuAuGfscsCfcAfaGfaAfAfGfuGfaAfaGfaCfcAf(C11-PEG3-NAG3) |
| AM03046-SS1157 | | uAuAugscsCfcAfagaAfAfGfugaAfagaCfcAf(C6-NAG3) |
| AM03052-SS1158 | | (NH2-Ser)uAuAuGfscsCfcAfaGfaAfAfGfuGfaAfaGfaCfc(invdA) |
| AM03053-SS1159 | | (NH2-Ser)(NH2-Ser)(NH2-Ser)uAuAuGfscsCfcAfaGfaAfAfGfuGfaAfaGfaCfc(invdA) |
| AM03054-SS1160 | | (Norbornene-Ser)uAuAuGfscsCfcAfaGfaAfAfGfuGfaAfaGfaCfc(invdA) |
| AM03055-SS1161 | | (Norbornene-Ser)(Norbornene-Ser)(Norbornene-Ser)uAuAuGfscsCfcAfaGfaAfAfGfuGfaAfaGfaCfc(invdA) |

TABLE 3-continued

Modified F12 RNAi trigger sense strand sequences.

| Strand ID | SEQ ID No. | Sense Sequence (5' → 3') |
|---|---|---|
| AM03056-SS1162 | | (NH2-C6)uAuAuGfscsCfcAfaGfaAfAfGfuGfaAfaGfaCfc(invdA) |
| AM03057-SS1163 | | (Norbornene-C6)uAuAuGfscsCfcAfaGfaAfAfGfuGfaAfaGfaCfc(invdA) |
| AM03071-SS1164 | | GfsgsAfgCfcCfaAfgAfaAfgUfgAf(C11-PEG3-NAG3) |
| AM03072-SS1165 | | CfscsCfaAfgAfaAfgUfgAfaAfgAf(C11-PEG3-NAG3) |
| AM03073-SS1166 | | AfsasGfaAfaGfuGfaAfaGfaCfcAf(C11-PEG3-NAG3) |
| AM03074-SS1167 | | AfsgsAfaAfgUfgAfaAfgAfcCfaAf(C11-PEG3-NAG3) |
| AM03083-SS1168 | | (Spermine)uAuAuGfscsCfcAfaGfaAfAfGfuGfaAfaGfaCfcAf(C11-PEG3-NAG3) |
| AM03084-SS1169 | | (Spermine)(Spermine)uAuAuGfscsCfcAfaGfaAfAfGfuGfaAfaGfaCfcAf(C11-PEG3-NAG3) |
| AM03085-SS1170 | | (Spermine)(Spermine)(Spermine)uAuAuGfscsCfcAfaGfaAfAfGfuGfaAfaGfaCfcAf(C11-PEG3-NAG3) |
| AM03086-SS1171 | | (NH2-C6)uAuAuGfscsCfcAfaGfaAfAfGfuGfaAfaGfaCfcAf(C6-NH2) |
| AM03112-SS1172 | | uAuAuGfscsCfcAfaGfaAfAfGfuGfaAfaGfaCfCMAM(C11-PEG3-NAG3) |
| AM03113-SS1173 | | uAuAULTNAGfscsCfcAfaGfaAfAfGfuGfaAfaGfaCfcAf(C11-PEG3-NAG3) |
| AM03114-SS1174 | | (Spermine)GfscsCfcAfaGfaAfAfGfuGfaAfaGfaCfcAf(C11-PEG3-NAG3) |
| AM03115-SS1175 | | (Spermine)(Spermine)(Spermine)GfscsCfcAfaGfaAfAfGfuGfaAfaGfaCfcAf(C11-PEG3-NAG3) |
| AM03117-SS1176 | | (Alk-C6-C6)uAuAuGfscsCfcAfaGfaAfAfGfuGfaAfaGfaCfcAf(C11-PEG3-NAG3) |
| AM03118-SS1177 | | (Alk-PEG4-C6)uAuAuGfscsCfcAfaGfaAfAfGfuGfaAfaGfaCfcAf(C11-PEG3-NAG3) |
| AM03132-SS1178 | | uAuAuGfscsCfcAfaGfaAfAfGfuGfaAfaGfaCfcAf(C6-NAG3) |
| AM03133-SS1179 | | uAuAuGfscsCfcAfaGfaAfAfGfuGfaAfaGfaCfcAf(C6-PEG4-NAG3) |
| AM03135-SS1180 | | (C6-PEG4-NAG3)uAuAuGfscsCfcAfaGfaAfAfGfuGfaAfaGfaCfc(invdA) |
| AM03136-SS1181 | | uAuAuGfscsCfcAfaGfaAfAfGfuGfaAfaGfauAu(C6-NH2) |
| AM03137-SS1182 | | uAuAuGfscsCfcAfaGfaAfAfGfuGfaAfaGfauAu(C6-PEG4-NAG3) |
| AM03138-SS1183 | | (TetZ-C6)uAuAuGfscsCfcAfaGfaAfAfGfuGfaAfaGfaCfcAf(C11-PEG3-NAG3) |
| AM03139-SS1184 | | (Alk-PEG5-C6)uAuAuGfscsCfcAfaGfaAfAfGfuGfaAfaGfaCfcAf(C11-PEG3-NAG3) |
| AM03140-SS1185 | | (Alk-NHCO-C6)uAuAuGfscsCfcAfaGfaAfAfGfuGfaAfaGfaCfcAf(C11-PEG3-NAG3) |
| AM03141-SS1186 | | (Alk-NHCO-SS-C6)uaUfauGfscsCfcAfaGfaAfAfGfuGfaAfaGfaCfcAf(C11-PEG3-NAG3) |
| AM03142-SS1187 | | uAuAusGfscCfcAfaGfaAfAfGfuGfaAfaGfaCfcAf(C11-PEG3-NAG3) |
| AM03143-SS1188 | | uAuAuGfsusGfcUfuUfgAfgCfcUfcAfgCfuUfcAf(C11-PEG3-NAG3) |
| AM03145-SS1189 | | (NH2-C6)(NH2-Ser)uAuAuGfscsCfcAfaGfaAfAfGfuGfaAfaGfaCfc(invdA) |

TABLE 3-continued

Modified F12 RNAi trigger sense strand sequences.

| Strand ID | SEQ ID No. | Sense Sequence (5' → 3') |
|---|---|---|
| AM03146-SS1190 | | (NH2-C6)(NH2-Ser)(NH2-Ser)uAuAuGfscsCfcAfaGfaAfAfGfuGfaAfaGfaCfc(invdA) |
| AM03147-SS1191 | | (NH2-C6)(NH2-Ser)(NH2-Ser)(NH2-Ser)uAuAuGfscsCfcAfaGfaAfAfGfuGfaAfaGfaCfc(invdA) |
| AM03152-SS1192 | | uAuAugscsccaagaaaGfuGfaaagacca(C11-PEG3-NAG3) |
| AM03153-SS1193 | | uAuAugscsccaagaaaGfugaaagacca(C11-PEG3-NAG3) |
| AM03177-SS1194 | | uAuAuGfscsCfcAfaGfaAfAfGfuGfaAfaGfaCfcAf(C6-C12-NAG3) |
| AM03178-SS1195 | | uAuAuGfscsCfcAfaGfaAfAfGfuGfaAfaGfaCfcAf(C11-palm-NAG3) |
| AM03179-SS1196 | | uAuAuGfscsCfcAfaGfaAfAfGfuGfaAfaGfaCfcAf(C6-SS-C6)(C11-palm-NAG3) |
| AM03180-SS1197 | | uAuAuGfscsCfcAfaGfaAfAfGfuGfaAfaGfauAu(C11-palm-NAG3) |
| AM03181-SS1198 | | (Alk-C6-C6)(Alk-C6-Ser)uAuAuGfscsCfcAfaGfaAfAfGfuGfaAfaGfaCfc(invdA) |
| AM03182-SS1199 | | (Alk-C6-C6)(Alk-C6-Ser)(Alk-C6-Ser)uAuAuGfscsCfcAfaGfaAfAfGfuGfaAfaGfaCfc(invdA) |
| AM03183-SS1200 | | (Alk-C6-C6)(Alk-C6-Ser)(Alk-C6-Ser)(Alk-C6-Ser)uAuAuGfscsCfcAfaGfaAfAfGfuGfaAfaGfaCfc(invdA) |
| AM03209-SS1201 | | uaUfaugscsccaagaAfaGfugaaagacca(C11-PEG3-NAG3) |
| AM03210-SS1202 | | uauaugscsccaagaAfaGfugaaagacca(C11-PEG3-NAG3) |
| AM03213-SS1203 | | udAudAugscsccaagaAfaGfugaaagacca(C11-PEG3-NAG3) |
| AM03214-SS1204 | | uAugscsccaagaAfaGfugaaagaccuAu(C11-PEG3-NAG3) |
| AM03217-SS1205 | | uAuAuGfscsCfcAfaGfaAfAfGfuGfaAfaGfaCfcAf(C6-C6-NAG3) |
| AM03218-SS1206 | | uAuAuGfscsCfcAfaGfaAfAfGfuGfaAfaGfaCfcAf(C6-SS-C6)(C11-PEG3-NAG3) |
| AM03327-SS1207 | | uAuAugscsccaagaaAfGfugaaagacCMAM(C11-PEG3-NAG3) |
| AM03328-SS1208 | | uAuAugscsccaagaaAfGfugaaagacca(C6-NH2) |
| AM03329-SS1209 | | uAuAugscsccaagaaAfGfugaaagacca(C6-NAG3) |
| AM03338-SS1210 | | uAuAugscsccaagaaAfGfugaaagacca(NH2-C7) |
| AM03339-SS1211 | | uAuAugscsccaagaaAfGfugaaagacca(NAG13) |
| AM03354-SS1212 | | cscscaAfgAfaagugaaaga(C11-PEG3-NAG3) |
| AM03355-SS1213 | | cscscaaGfAfaagugaaaga(C11-PEG3-NAG3) |
| AM03356-SS1214 | | CfscsCfaAfgAfaAfgUfgAfaAfGMAM(C11-PEG3-NAG3) |
| AM03357-SS1215 | | CMsCMsCfaAfgAfaAfgUfgAfaAfGMAM(C11-PEG3-NAG3) |
| AM03358-SS1216 | | CMsCMsCfaAfgAfaAfgUfgAfaAfgAf(C11-PEG3-NAG3) |
| AM03360-SS1217 | | asasgaAfaGfugaaagacca(C11-PEG3-NAG3) |
| AM03361-SS1218 | | asasgaaAfGfugaaagacca(C11-PEG3-NAG3) |
| AM03362-SS1219 | | AfsasGfaAfaGfuGfaAfaGfaCfCMAM(C11-PEG3-NAG3) |
| AM03363-SS1220 | | AMsAMsGfaAfaGfuGfaAfaGfaCfCMAM(C11-PEG3-NAG3) |
| AM03364-SS1221 | | AMsAMsGfaAfaGfuGfaAfaGfaCfcAf(C11-PEG3-NAG3) |
| AM03369-SS1222 | | (NH2-Ser)uAuAugscsccaagaAfaGfugaaagacc(invdA) |
| AM03370-SS1223 | | (NH2-C6)(NH2-Ser)uAuAugscsccaagaAfaGfugaaagacc(invdA) |

TABLE 3-continued

Modified F12 RNAi trigger sense strand sequences.

| Strand ID | SEQ ID No. | Sense Sequence (5' → 3') |
|---|---|---|
| AM03371-SS1224 | | (NH2-C6)(NH2-Ser)(NH2-Ser)(NH2-Ser)uAuAugscsccaagaAfaGfugaaagacc(invdA) |
| AM03372-SS1225 | | (Alk-C6-Ser)uAuAugscsccaagaAfaGfugaaagacc(invdA) |
| AM03373-SS1226 | | (Alk-C6-C6)(Alk-C6-Ser)uAuAugscsccaagaAfaGfugaaagacc(invdA) |
| AM03374-SS1227 | | (Alk-C6-C6)(Alk-C6-Ser)3(Alk-C6-Ser)(Alk-C6-Ser)uAuAugscsccaagaAfaGfugaaagacc(invdA) |
| AM03398-SS1228 | | (Chol-TEG)uAuAugscsccaagaAfaGfugaaagacc(invdA) |
| AM03399-SS1229 | | (Chol-TEG)uAuAugscsccaagaAfaGfugaaagacca |
| AM03400-SS1230 | | (NH2-Ser)uauaugscsccaagaAfaGfugaaagacc(invdA) |
| AM03401-SS1231 | | (Alk-C6-Ser)uauaugscsccaagaAfaGfugaaagacc(invdA) |
| AM03402-SS1232 | | uAuAugscsccaagaAfaGfugaaagacca(NAG13) |
| AM03403-SS1233 | | uAuAugscsccaagaAfAfGfugaaagacca(NAG13) |
| AM03404-SS1234 | | uAuAugscsccaagaAfAfgugaaagacca(NAG13) |
| AM03405-SS1235 | | uAuAugscsccaagaaaGfUfgaaagacca(NAG13) |
| AM03406-SS1236 | | uAuAugscsccaagaAfaGfugaaagacCMAM(NAG13) |
| AM03407-SS1237 | | uAugscsccaagaAfaGfugaaagaccaAu(NAG13) |
| AM03408-SS1238 | | uAugscsccaagaAfaGfugaaagaccuAu(NAG13) |
| AM03409-SS1239 | | uaugscsccaagaAfaGfugaaagaccuAu(NAG13) |
| AM03411-SS1240 | | uAuAusgsccaagaAfaGfugaaagacca(NAG13) |
| AM03412-SS1241 | | uAuAsusgcccaagaAfaGfugaaagacca(NAG13) |
| AM03413-SS1242 | | uAuAugscсccaagaAfaGfugaaagacca(NAG13) |
| AM03414-SS1243 | | uAuAugcsccaagaAfaGfugaaagacca(NAG13) |
| AM03420-SS1244 | | (NH2-C6)(NH2-Ser)uAugscsccaagaAfaGfugaaagaccuAu(Ser-NH2)(C6-NH2) |
| AM03421-SS1245 | | (Alk-C6-C6)(Alk-C6-Ser)uAugscsccaagaAfaGfugaaagaccuAu(Ser-C6-Alk)(C6-C6-Alk) |
| AM03422-SS1246 | | (NH2-C6)uAugscsccaagaAfaGfugaaagaccuAu(C6-NH2) |
| AM03423-SS1247 | | (Alk-C6-C6)uAugscsccaagaAfaGfugaaagaccuAu(C6-C6-Alk) |
| AM03428-SS1248 | | uAugscsccaagaAfaGfugaaagaccsusAu(NAG13) |
| AM03429-SS1249 | | uAugscsccaagaAfaGfugaaagacc(invdA)Au(NAG13) |
| AM03430-SS1250 | | uAugscsccaagaAfaGfugaaagacCMAMAu(NAG13) |
| AM03431-SS1251 | | (NH2-C6)uAuAugscsccaagaAfaGfugaaagacc(invdA) |
| AM03432-SS1252 | | (Alk-C6-C6)uAuAugscsccaagaAfaGfugaaagacc(invdA) |
| AM03433-SS1253 | | (NH2-C6)uauaugscsccaagaAfaGfugaaagacc(invdA) |
| AM03434-SS1254 | | (Alk-C6-C6)uauaugscsccaagaAfaGfugaaagacc(invdA) |
| AM03435-SS1255 | | (Alk-PEG5-Ser)uAuAugscsccaagaAfaGfugaaagacc(invdA) |
| AM03436-SS1256 | | (Alk-PEG5-C6)(Alk-PEG5-Ser)uAuAugscsccaagaAfaGfugaaagacc(invdA) |
| AM03437-SS1257 | | (Alk-PEG5-Ser)uauaugscsccaagaAfaGfugaaagacc(invdA) |

TABLE 3-continued

Modified F12 RNAi trigger sense strand sequences.

| Strand ID | SEQ ID No. | Sense Sequence (5' → 3') |
|---|---|---|
| AM03438-SS1258 | | (Alk-PEG5-C6)uAuAugscsccaagaAfaGfugaaagacc(invdA) |
| AM03439-SS1259 | | (Alk-PEG5-C6)uauaugscsccaagaAfaGfugaaagacc(invdA) |
| AM03440-SS1260 | | (Alk-PEG5-C6)uAugscsccaagaAfaGfugaaagaccuAu(C6-PEG5-Alk) |
| AM03456-SS1261 | | uAuAugscsccaagaAfaGfugaaagaccAuTA(NAG13) |
| AM03463-SS1262 | | uAuAuGurAscsccaagaAfaGfugaaagaccAuTA(NAG13) |
| AM03464-SS1263 | | uAuAuGLNAscsccaagaAfaGfugaaagacca(NAG13) |
| AM03476-SS1264 | | uAugscsccaagaAfaGfugaaagaccuau(NAG13) |
| AM03477-SS1265 | | uAugscsccaagaAfaGfugaaagaccudAu(NAG13) |
| AM03478-SS1266 | | uAugscsccaagaAfaGfugaaagaccaau(NAG13) |
| AM03479-SS1267 | | uAugscsccaagaAfaGfugaaagaccauu(NAG13) |
| AM03480-SS1268 | | uAugscsccaagaAfaGfugaaagaccaua(NAG13) |
| AM03481-SS1269 | | uAugscsccaagaAfaGfugaaagaccaUu(NAG13) |
| AM03482-SS1270 | | uAugscsccaagaAfaGfugaaagaccaUa(NAG13) |
| AM03520-SS1271 | | uAuAuGLNAcsccaagaAfaGfugaaagacca(NAG13) |
| AM03521-SS1272 | | uAuAuGLNAcsccaagaAfaGfugaaagaccALNA(NAG13) |
| AM03540-SS1273 | | (Alk-PEG13-C6)uAuAugscsccaagaAfaGfugaaagacc(invdA) |
| AM03541-SS1274 | | (Alk-PEG13-C6)(Alk-PEG13-Ser)uAuAugscsccaagaAfaGfugaaagacc(invdA) |
| AM03570-SS1275 | | (NH2-C6)uuAgagscsccaagaAfaGfugaaagacc(invdA) |
| AM03571-SS1276 | | (Alk-C6-C6)uuAgagscsccaagaAfaGfugaaagacc(invdA) |
| AM03572-SS1277 | | (NH2-C6)uuAuugscsccaagaAfaGfugaaagacc(invdA) |
| AM03573-SS1278 | | (Alk-C6-C6)uuAuugscsccaagaAfaGfugaaagacc(invdA) |
| AM03574-SS1279 | | (NH2-C6)uuGAugscsccaagaAfaGfugaaagacc(invdA) |
| AM03575-SS1280 | | (Alk-C6-C6)uuGAugscsccaagaAfaGfugaaagacc(invdA) |
| AM03576-SS1281 | | (NH2-C6)uuagagscsccaagaAfaGfugaaagacc(invdA) |
| AM03577-SS1282 | | (Alk-C6-C6)uuagagscsccaagaAfaGfugaaagacc(invdA) |
| AM03578-SS1283 | | (NH2-C6)uAugagscsccaagaAfaGfugaaagacc(invdA) |
| AM03579-SS1284 | | (Alk-C6-C6)uAugagscsccaagaAfaGfugaaagacc(invdA) |
| AM03582-SS1285 | | uAuAugscsccaagaAfaGfugaaagacca(C6-NH2) |
| AM03583-SS1286 | | uAugscsccaagaAfaGfugaaagaccuAu(C6-NH2) |
| AM03586-SS1287 | | (Chol-TEG)aUaGasGfcCfcAfAfgaAfaGfuGfaAfaGfaCfc(invdA) |
| AM03587-SS1288 | | (Chol-TEG)uauausGfcCfcAfAfgaAfaGfuGfaAfaGfaCfc(invdA) |
| AM03588-SS1289 | | uAuAugscsccaagaAfaGfugaaagacca(NAG14) |
| AM03591-SS1290 | | AugscsccaagaAfaGfugaaagaccuAuu(NAG13) |
| AM03592-SS1291 | | AugscsccaagaAfaGfugaaagaccuGAu(NAG13) |
| AM03628-SS1292 | | uAuAugscsccaagaAfaGfugaaagacca(NAG15) |
| AM03629-SS1293 | | uAuAugscsccaagaAfaGfugaaagacca(NAG16) |

TABLE 3-continued

Modified F12 RNAi trigger sense strand sequences.

| Strand ID | SEQ ID No. | Sense Sequence (5' → 3') |
|---|---|---|
| AM03630-SS1294 | | uAuAugscsccaagaAfaGfugaaagacca(NAG17) |
| AM03631-SS1295 | | (NAG18)uAuAugscsccaagaAfaGfugaaagacc(invdA) |
| AM03632-SS1296 | | (NAG18)uauaugscsccaagaAfaGfugaaagacc(invdA) |
| AM03633-SS1297 | | uAuAugscsccaagaAfaGfugaaagacca(NAG18) |
| AM03634-SS1298 | | uAugscsccaagaAfaGfugaaagaccuAu(NAG18) |
| AM03635-SS1299 | | (NAG19)uAuAugscsccaagaAfaGfugaaagacc(invdA) |
| AM03636-SS1300 | | (NAG19)uauaugscsccaagaAfaGfugaaagacc(invdA) |
| AM03637-SS1301 | | uAuAugscsccaagaAfaGfugaaagacca(NAG19) |
| AM03638-SS1302 | | uAugscsccaagaAfaGfugaaagaccuAu(NAG19) |
| AM03639-SS1303 | | (NAG20)uAuAugscsccaagaAfaGfugaaagacc(invdA) |
| AM03640-SS1304 | | (NAG20)uauaugscsccaagaAfaGfugaaagacc(invdA) |
| AM03641-SS1305 | | uAuAugscsccaagaAfaGfugaaagacca(NAG20) |
| AM03642-SS1306 | | uAugscsccaagaAfaGfugaaagaccuAu(NAG20) |
| AM03653-SS1359 | | uauaugscsccaagaAfaGfugaaagacca(NAG13) |
| AM03654-SS1360 | | udAudAugscsccaagaAfaGfugaaagacca(NAG13) |
| AM03669-SS1361 | | uAuAugscsccaagaAfaGfugaaagacc(invdA)(NAG13) |
| AM03684-SS1362 | | uAuAugscsccaagaAfaGfugaaagacca |
| AM03703-SS1363 | | (NAG21)uAuAugscsccaagaAfaGfugaaagacc(invdA) |
| AM03704-SS1364 | | (NAG21)uauaugscsccaagaAfaGfugaaagacc(invdA) |
| AM03705-SS1357 | | gagscsccaagaAfaGfugaaagaccuAuu(NAG13) |
| AM03706-SS1358 | | gagscsccaagaAfaGfugaaagaccuGAu(NAG13) |
| AM03726-SS1351 | | cscscaAfgAfaagugaaaga(NAG13) |
| AM03727-SS1352 | | XscsccaAfgAfaagugaaaga(NAG13) |
| AM03728-SS1353 | | XsXscccaAfgAfaagugaaaga(NAG13) |
| AM03729-SS1354 | | CMsCMscaAfgAfaagugaaaGMAM(NAG13) |
| AM03730-SS1355 | | cscscaAfgAfaagugaaaGMAM(NAG13) |
| AM03731-SS1356 | | cscscaAfgAfaagugaaagu(NAG13) |
| AM03738-SS1365 | | (NAG23)uAuAugscsccaagaAfaGfugaaagacc(invdA) |
| AM03739-SS1366 | | (NAG23)uauaugscsccaagaAfaGfugaaagacc(invdA) |
| AM03775-SS1367 | | udAuaugscsccaagaAfaGfugaaagacca(NAG13) |
| AM03776-SS1374 | | udAugagscsccaagaAfaGfugaaagacca(NAG13) |
| AM03777-SS1349 | | adTagagscsccaagaAfaGfugaaagacca(NAG13) |
| AM03778-SS1350 | | auagagscsccaagaAfaGfugaaagacca(NAG13) |
| AM03779-SS1368 | | uauaugscsccaagaAfaGfugaaagacc(invdA)(NAG13) |
| AM03780-SS1369 | | u(invdA)uaugscsccaagaAfaGfugaaagacca(NAG13) |
| AM03781-SS1373 | | udAuaugscsccaagaAfaGfugaaagaccu(NAG13) |
| AM03782-SS1370 | | udAuaugscsccaagaAfaGfugaaagacc(invdA)(NAG13) |

TABLE 3-continued

Modified F12 RNAi trigger sense strand sequences.

| Strand ID | SEQ ID No. | Sense Sequence (5' → 3') |
|---|---|---|
| AM03783-SS1371 | | udAuaugscsccaagaAfaGfugaaagacc(inva)(NAG13) |
| AM03784-SS1372 | | udAuaugscsccaagaAfaGfugaaagacc(3'OMea)(NAG13) |
| AM03800-SS2206 | | gacaugscsccaagaAfaGfugaaagacca(NAG13) |
| AM03801-SS2207 | | ugaaugscsccaagaAfaGfugaaagacca(NAG13) |
| AM03802-SS2208 | | gcgaugscsccaagaAfaGfugaaagacca(NAG13) |
| AM03806-SS2209 | | uaugagscsccaagaAfaGfugaaagacca(NAG13) |
| AM03807-SS2210 | | uuggagscsccaagaAfaGfugaaagacca(NAG13) |
| AM03812-SS2211 | | cscscaAfgAfaagugaaagALNA(NAG13) |
| AM03813-SS2212 | | cscscaAfgAfaagugaaaGLNAa(NAG13) |
| AM03814-SS2213 | | csmCLNAscaAfgAfaagugaaaga(NAG13) |
| AM03815-SS2214 | | mCLNAscscaAfgAfaagugaaaga(NAG13) |
| AM03816-ss2215 | | cscscaAfgAfaagugaaaGLNAALNA(NAG13) |
| AM03817-SS2216 | | mCLNAsmCLNAscaAfgAfaagugaaaga(NAG13) |
| AM03818-SS2217 | | mCLNAscscaAfgAfaagugaaagALNA(NAG13) |
| AM03834-SS2218 | | CfscsCfaAfgAfaAfgUfgAfaAfGMAM(NAG13) |
| AM03836-SS2219 | | (NAG18)uaugagscsccaagaAfaGfugaaagacc(invdA) |
| AM03838-SS2220 | | (NAG18)auagagscsccaagaAfaGfugaaagacc(invdA) |
| AM03840-SS2221 | | (NAG18)gacaugscsccaagaAfaGfugaaagacc(invdA) |
| AM03842-SS2222 | | (NAG18)ugaaugscsccaagaAfaGfugaaagacc(invdA) |
| AM03844-SS2223 | | (NAG18)gcgaugscsccaagaAfaGfugaaagacc(invdA) |
| AM03846-SS2224 | | (NAG18)uauaugcccaagaAfaGfugaaagacc(invdA) |
| AM03848-SS2225 | | (NAG18)uauaugcccaagaAfaGfugaaagacCM(invdA) |
| AM03850-SS2226 | | (NAG18)uauaugcccaagaAfaGfugaaagaCMCM(invdA) |
| AM03886-SS2227 | | (Alk-PEG4-C6)uauaugscsccaagaAfaGfugaaagacca(NAG13) |
| | 1940 | UfgGfaGfuCfaAfcAfcUfuUfcGfaAfdT |
| | 1941 | GfgAfgUfcAfaCfaCfuUfuCfgAfuAfdT |
| | 1942 | CfcCfaAfgGfaGfcAfuAfaGfuAfcAfdT |
| | 1943 | CfcAfaGfgAfgCfaUfaAfgUfaCfaAfdT |
| | 1944 | CfaAfgGfaGfcAfuAfaGfuAfcAfaAfdT |
| | 1945 | AfgCfaUfaAfgUfaCfaAfaGfcUfgAfdT |
| | 1946 | UfgAfaGfaGfcAfcAfcAfgUfcGfuAfdT |
| | 1947 | GfaAfgAfgCfaCfaCfaGfuCfgUfuAfdT |
| | 1948 | AfaGfaGfcAfcAfcAfgUfcGfuUfcAfdT |
| | 1949 | CfaCfaGfuCfgUfuCfuCfaCfuGfuAfdT |
| | 1950 | CfaGfuCfgUfuCfuCfaCfuGfuCfaAfdT |
| | 1951 | GfcUfgUfaCfcAfcAfaAfuGfuAfcAfdT |
| | 1952 | CfuGfuAfcCfaCfaAfaUfgUfaCfcAfdT |

TABLE 3-continued

Modified F12 RNAi trigger sense strand sequences.

| Strand ID | SEQ ID No. | Sense Sequence (5' → 3') |
|---|---|---|
| | 1953 | UfgUfaCfcAfcAfaAfuGfuAfcCfcAfdT |
| | 1954 | CfcAfcAfaAfuGfuAfcCfcAfcAfaAfdT |
| | 1955 | AfgAfuGfcCfaGfuGfcAfaGfgGfuAfdT |
| | 1956 | GfgGfgUfcGfcUfgCfcUfaGfaGfgAfdT |
| | 1957 | GfcUfgCfuAfuGfaUfgGfcCfgCfgAfdT |
| | 1958 | CfuGfcUfaUfgAfuGfgCfcGfcGfgAfdT |
| | 1959 | UfgGfcCfgCfgGfgCfuCfaGfcUfaAfdT |
| | 1960 | CfcGfcGfgGfcUfcAfgCfuAfcCfgAfdT |
| | 1961 | GfaCffAfcGfcUfcUfcGfgGfuGfcAfdT |
| | 1962 | AfcCfaCfgCfuCfuCfgGfgUfgCfgAfdT |
| | 1963 | CfcAfcGfcUfcUfcGfgGfuGfcGfcAfdT |
| | 1964 | AfaGfcGfcGfgAfaCfuGfgGfgAfcAfdT |
| | 1965 | GfgAfcUfgGfgCfgGfcCfaCfgCfcAfdT |
| | 1966 | GfcCfgGfaAfcCfcGfgAfcAfaCfgAfdT |
| | 1967 | CfgGfaAfcCfcGfgAfcAfaCfgAfcAfdT |
| | 1968 | GfgAfaCfcCfgGfaCfaAfcGfaCfaAfdT |
| | 1969 | GfaAfcCfcGfgAfcAfaCfgAfcAfuAfdT |
| | 1970 | CfcGfgAfcAfaCfgAfcAfuCfcGfcAfdT |
| | 1971 | AfcAfaCfgAfcAfuCfcGfcCfcGfuAfdT |
| | 1972 | CfaAfcGfaCfaUfcCfgCfcCfgUfgAfdT |
| | 1973 | AfaCfgAfcAfuCfcGfcCfcGfuGfgAfdT |
| | 1974 | AfcGfaCfaUfcCfgCfcCfgUfgGfuAfdT |
| | 1975 | CfaUfcCfgCfcCfgUfgGfuGfcUfuAfdT |
| | 1976 | AfuCfcGfcCfcGfuGfgUfgCfuUfcAfdT |
| | 1977 | CfcGfcCfcGfuGfgUfgCfuUfcGfuAfdT |
| | 1978 | GfcCfcGfuGfgUfgCfuUfcGfuGfcAfdT |
| | 1979 | CfuUfcAfuGfuCfcCfaCfuCfaUfgAfdT |
| | 1980 | GfcAfgCfcGfgCfaCfcGfcCfgAfaAfdT |
| | 1981 | GfgCfuCfcGfcAfaGfaGfuCfuGfuAfdT |
| | 1982 | GfcUfcCfgCfaAfgAfgUfcUfgUfcAfdT |
| | 1983 | GfaGfuCfuGfuCfuUfcGfaUfgAfcAfdT |
| | 1984 | AfgUfcUfgUfcUfuCfgAfuGfaCfcAfdT |
| | 1985 | GfuCfuUfcGfaUfgAfcCfcGfcGfuAfdT |
| | 1986 | UfcUfuCfgAfuGfaCfcCfgCfgUfcAfdT |
| | 1987 | CfuUfcGfaUfgAfcCfcGfcGfuCfgAfdT |
| | 1988 | UfuCfgAfuGfaCfcCfgCfgUfcGfuAfdT |
| | 1989 | UfcGfaUfgAfcCfcGfcGfuCfgUfuAfdT |

TABLE 3-continued

Modified F12 RNAi trigger sense strand sequences.

| Strand ID | SEQ ID No. | Sense Sequence (5' → 3') |
|---|---|---|
| | 1990 | CfgAfuGfaCfcCfgCfgUfcGfuUfgAfdT |
| | 1991 | GfaUfgAfcCfcGfcGfuCfgUfuGfgAfdT |
| | 1992 | UfgAfcCfcGfcGfuCfgUfuGfgCfgAfdT |
| | 1993 | GfaCfcCfgCfgUfcGfuUfgGfcGfgAfdT |
| | 1994 | GfcUfgGfuGfgCfgCfuAfcGfcGfgAfdT |
| | 1995 | UfgGfuGfgCfgCfuAfcGfcGfgGfgAfdT |
| | 1996 | GfgUfgGfcGfcUfaCfgCfgGfgGfcAfdT |
| | 1997 | GfuGfgCfgCfuAfcGfcGfgGfgCfgAfdT |
| | 1998 | GfcUfaCfgCfgGfgGfcGfcAfcCfcAfdT |
| | 1999 | GfgCfgCfaCfcCfcUfaCfaUfcGfcAfdT |
| | 2000 | CfaCfcCfcUfaCfaUfcGfcCfgCfgAfdT |
| | 2001 | CfcCfcUfaCfaUfcGfcCfgCfgCfuAfdT |
| | 2002 | CfcCfuAfcAfuCfgCfcGfcGfcUfgAfdT |
| | 2003 | CfcUfaCfaUfcGfcCfgCfgCfuGfuAfdT |
| | 2004 | CfuAfcAfuCfgCfcGfcGfcUfgUfaAfdT |
| | 2005 | UfaCfaUfcGfcCfgCfgCfuGfuAfcAfdT |
| | 2006 | CfaUfcGfcCfgCfgCfuGfuAfcUfgAfdT |
| | 2007 | UfcGfcCfgCfgCfuGfuAfcUfgGfgAfdT |
| | 2008 | CfuGfcGfcCfgGfcAfgCfcUfcAfuAfdT |
| | 2009 | GfcAfcCfcGfaGfgAfuCfuGfaCfgAfdT |
| | 2010 | CfaCfcCfgAfgGfaUfcUfgAfcGfgAfdT |
| | 2011 | UfuGfcAfcGfaGfgCfcUfuCfuCfgAfdT |
| | 2012 | UfgCfaCfgAfgGfcCfuUfcUfcGfcAfdT |
| | 2013 | GfcAfcGfaCfcUfgGfcUfcUfgUfuAfdT |
| | 2014 | GfcUfcUfgUfuGfcGfcCfuUfcAfgAfdT |
| | 2015 | UfuGfcGfcCfuUfcAfgGfaGfgAfuAfdT |
| | 2016 | GfgAfcGfgCfaGfcUfgCfgCfgCfuAfdT |
| | 2017 | CfgCfgCfuCfcUfgUfcGfcCfuUfaAfdT |
| | 2018 | GfcGfcUfcCfuGfuCfgCfcUfuAfcAfdT |
| | 2019 | CfgCfuCfcUfgUfcGfcCfuUfaCfgAfdT |
| | 2020 | GfcUfcCfuGfuCfgCfcUfuAfcGfuAfdT |
| | 2021 | CfuCfcUfgUfcGfcCfuUfaCfgUfuAfdT |
| | 2022 | UfcCfuGfuCfgCfcUfuAfcGfuUfcAfdT |
| | 2023 | UfgUfcGfcCfuUfaCfgUfuCfaGfcAfdT |
| | 2024 | GfuCfgCfcUfuAfcGfuUfcAfgCfcAfdT |
| | 2025 | UfcGfcCfuUfaCfgUfuCfaGfcCfgAfdT |
| | 2026 | CfgCfcUfuAfcGfuUfcAfgCfcGfgAfdT |

TABLE 3-continued

Modified F12 RNAi trigger sense strand sequences.

| Strand ID | SEQ ID No. | Sense Sequence (5' → 3') |
|---|---|---|
| | 2027 | GfcCfuUfaCfgUfuCfaGfcCfgGfuAfdT |
| | 2028 | CfuUfaCfgUfuCfaGfcCfgGfuGfuAfdT |
| | 2029 | AfcGfuUfcAfgCfcGfgUfgUfgCfcAfdT |
| | 2030 | GfgUfgUfgCfcUfgCfcAfaGfcGfgAfdT |
| | 2031 | GfcCfaCfcAfgUfuCfgAfgGfgGfgAfdT |
| | 2032 | CfaCfcAfgUfuCfgAfgGfgGfgCfgAfdT |
| | 2033 | UfcGfaGfgGfgGfcGfgAfgGfaAfuAfdT |
| | 2034 | CfuGfcGfcAfgGfgUfuCfcUfcGfaAfdT |
| | 2035 | UfgCfgCfaGfgGfuUfcCfuCfgAfgAfdT |
| | 2036 | GfcGfcAfgGfgUfuCfcUfcGfaGfgAfdT |
| | 2037 | UfuCfcUfcGfaGfgGfcGfgCfaCfcAfdT |
| | 2038 | CfuCfgAfgGfgCfgGfcAfcCfgAfuAfdT |
| | 2039 | UfcGfaGfgGfcGfgCfaCfcGfaUfgAfdT |
| | 2040 | CfaGfaGfcGfcCfgGfcUfcAfcCfcAfdT |
| | 2041 | AfuCfaGfcUfgGfgGfaUfcGfgGfcAfdT |
| | 2042 | GfaUfcGfgGfcUfgUfgGfuGfaCfcAfdT |
| | 2043 | CfcGfcAfaCfaAfgCfcAfgGfcGfuAfdT |
| | 2044 | GfcAfaCfaAfgCfcAfgGfcGfuCfuAfdT |
| | 2045 | AfgGfcGfuCfuAfcAfcCfgAfuGfuAfdT |
| | 2046 | GfgCfgUfcUfaCfaCfcGfaUfgUfgAfdT |
| | 2047 | GfcGfuCfuAfcAfcCfgAfuGfuGfgAfdT |
| | 2048 | CfuGfgAfuCfcGfgGfaGfcAfcAfcAfdT |
| | 2049 | CfuGfaUfuGfcUfcAfgGfgAfcUfcAfdT |
| | 2050 | AfuUfgCfuCfaGfgGfaCfuCfaUfcAfdT |
| | 2051 | AfgGfaAfcUfcAfaUfaAfaGfuGfcAfdT |
| | 2052 | GfgAfaCfuCfaAfuAfaAfgUfgCfuAfdT |

A sense strand containing a sequence listed in Table 1 or 3 can be hybridized to any antisense strand containing a sequence listed in Table 1 or 2 provided the two sequences have a region of at least 90% complementarity over a contiguous 16, 17, 18, 19, 20, or 21 nucleotide sequence; representative sequences are exemplified by the Duplex ID Nos. shown in Table 24. In some embodiments an F12 RNAi trigger consists of any of the Duplex ID Nos. presented herein. In some embodiments an F12 RNAi trigger comprises of any of the Duplex ID Nos. presented herein. In some embodiments, an F12 RNAi trigger comprises the sense strand and antisense strand nucleotide sequences of any of the Duplex ID Nos. presented herein. In some embodiments, an F12 RNAi trigger comprises the sense strand and antisense strand nucleotide sequences of any of the Duplex ID Nos. presented herein and a targeting group and/or linking group wherein the targeting group and/or linking group is covalently linked to the sense strand or the antisense strand. In some embodiments, an F12 RNAi trigger comprises the sense strand and antisense strand modified nucleotide sequences of any of the Duplex ID Nos. presented herein. In some embodiments, an F12 RNAi trigger comprises the sense strand and antisense strand modified nucleotide sequences of any of the Duplex ID Nos. presented herein and a targeting group and/or linking group wherein the targeting group and/or linking group is covalently linked to the sense strand or the antisense strand. In some embodiments, a F12 RNAi trigger comprises Duplex ID Nos. AD00900, AD01001, AD01520, AD02639, AD02640, AD02023, AD02642, AD02708, AD02807, AD02822, AD02867, or AD02868. In some embodiments, a F12 RNAi trigger comprises SEQ ID No. 11, SEQ ID No. 150, or SEQ ID No. 177. In some embodiments, a F12 RNAi trigger comprises SEQ ID No 374 or SEQ ID No. 379.

In some embodiments, an F12 RNAi trigger further includes a targeting group, linking group, delivery polymer and/or other non-nucleotide group covalently linked to the 3' and/or 5' end of either the sense strand and/or the antisense strand. In some embodiments, an F12 RNAi trigger can contain a targeting group, linking group, delivery polymer, or other non-nucleotide group covalently linked to the 3' and/or 5' end of the sense strand. In some embodiments a targeting group, linking group, delivery polymer, or other non-nucleotide group is linked to the 5' end of an F12 RNAi trigger sense strand. In some embodiments, the targeting group, linking group, and/or delivery vehicle is linked directly or indirectly to the trigger via a linker/linking group. In some embodiments, a targeting group or delivery vehicle is linked to the trigger via a labile, cleavable, or reversible bond or linker. Examples of targeting groups and linking groups are provided in Table 4. Table 4 provides several embodiments of F12 RNAi trigger sense strands having a targeting group or linking group linked to the 5' or 3' end.

A targeting group can enhance the pharmacokinetic or biodistribution properties of an RNAi trigger or conjugate to which it is attached to improve cell- or tissue-specific distribution and cell-specific uptake of the conjugate. In some instances, binding of a targeting group to a cell or cell receptor may initiate endocytosis. A targeting group can be monovalent, divalent, trivalent, tetravalent, or have higher valency. Representative targeting groups include, without limitation, compounds with affinity to cell surface molecule, cell receptor ligands, hapten, antibodies, monoclonal antibodies, antibody fragments, and antibody mimics with affinity to cell surface molecules. Simply by way of example, a variety of ligands can be used to target drugs and genes to cells and to specific cellular receptors, including, without limitation, carbohydrates, glycans, saccharides (including, but not limited to: galactose, galactose derivatives (such as, for example, N-acetyl-galactosamine), mannose, and mannose derivatives), vitamins, folate, biotin, aptamers, and peptides (including, but not limited to: RGD-containing peptides, insulin, EGF, and transferrin). In some embodiments, a targeting group can be linked to an RNAi trigger using a linker, such as a PEG linker or one, two, or three abasic and/or ribitol groups.

In some embodiments, any of the F12 RNAi triggers listed in Table 3 which contain a 3' or 5' targeting group or linking group, may alternatively contain no 3' or 5' targeting group or linking group, or may contain a different 3' or 5' targeting group or linking group including, but not limited to, those depicted in Table 4. In some embodiments, an F12 RNAi trigger can include a hydrophobic group such as a cholesterol or a targeting group (e.g. a galactose cluster).

In some embodiments, a targeting group can include or consist of a hydrophobic group. In some embodiments, the hydrophobic group contains at least 20 carbon atoms. Hydrophobic groups can be hydrocarbons (e.g., containing only carbon and hydrogen atoms). However, substitutions or heteroatoms that maintain hydrophobicity, for example fluorine, are permitted. Hydrophobic groups useful as targeting groups include, without limitation, alkyl group, alkenyl group, alkynyl group, aryl group, aralkyl group, aralkenyl group, and aralkynyl group, each of which may be linear, branched, or cyclic, cholesterol, cholesteryl derivative, sterol, steroid, and steroid derivative. Examples of suitable hydrophobic groups include, without limiation: cholesterol, cholesteryl derivatives, dicholesterol, tocopherol, ditocopherol, didecyl, didodecyl, dioctadecyl, didodecyl, dioctadecyl, isoprenoid, and choleamide.

In some embodiments, a targeting group can include or consist of one or more galactose derivatives or galactose clusters. As used herein, the term galactose derivative includes both galactose and derivatives of galactose having affinity for the asialoglycoprotein receptor that is equal to or greater than that of galactose. Galactose derivatives include, but are not limited to: galactose, galactosamine, N-formyl-galactosamine, N-acetyl-galactosamine, N-propionyl-galactosamine, N-n-butanoyl-galactosamine, and N-iso-butanoyl-galactos-amine (see for example: Iobst, S. T. and Drickamer, K. J.B.C. 1996, 271, 6686). Galactose derivatives and galactose clusters that are useful for in vivo targeting or oligonucleotides and other molecules to the liver are well known in the art (see, for example, Baenziger and Fiete, 1980, Cell, 22, 611-620; Connolly et al., 1982, J. Biol. Chem., 257, 939-945).

As used herein, a galactose cluster comprises a molecule having two to four terminal galactose derivatives. A terminal galactose derivative c attached to a molecule through its C-1 carbon. In some embodiments, the galactose cluster is a galactose derivative trimer, tri-antennary galactose derivative, tri-valent galactose derivative. In some embodiments, the galactose cluster is comprised of N-acetyl-galactosamine (GalNAc). In some embodiments, the galactose cluster comprises a tri-valent N-acetyl-galactosamine.

As used herein, a galactose derivative trimer contains three galactose derivatives, each linked to a central branch point. The galactose derivatives can be attached to the central branch point through the C-1 carbons of the saccharides. In some embodiments, the galactose derivatives are linked to the branch point via linkers or spacers. In some embodiments, the linker or spacer is a flexible hydrophilic spacer, such as a PEG group (see, for example, U.S. Pat. No. 5,885,968; Biessen et al. J. Med. Chem. 1995 Vol. 39 p. 1538-1546). The branch point can be any small molecule which permits attachment of the three galactose derivatives and further permits attachment of the branch point to the RNAi trigger. An example of branch point group is a di-lysine or di-glutamate. Attachment of the branch point to the RNAi trigger can occur through a linker or spacer.

In some embodiments, pharmaceutical compositions for delivering an F12 RNAi trigger to a liver cell in vivo are described. Such pharmaceutical compositions can include, for example, an F12 RNAi trigger conjugated to a galactose cluster. In some embodiments, the galactose cluster is comprised of a galactose derivative trimer, which can be, for example, an N-acetyl-galactosamine trimer.

In some embodiments, an F12 RNAi trigger includes a linking group conjugated to the trigger. The linking group facilitates covalent linkage of the trigger to a targeting group or delivery polymer. The linking group can be linked to the 3' or the 5' end of the RNAi trigger sense strand or antisense strand. In some embodiments, the linking group is linked to the RNAi trigger sense strand. In some embodiments, the linking group is conjugated to the 5' or 3' end of an RNAi trigger sense strand. In some embodiments a linking group is conjugated to the 5' end of an RNAi trigger sense strand. Examples of linking groups, include or consist of, but are not limited to: Alk-SMPT-C6, Alk-SS-C6, DBCO-TEG, Me-Alk-SS-C6, and C6-SS-Alk-Me, reactive groups such a primary amines and alkynes, alkyl groups, abasic ribose, ribitol, and/or PEG groups.

A linker or linking group is a connection between two atoms that links one chemical group (such as an RNAi agent) or segment of interest to another chemical group (such as a targeting group or delivery polymer) or segment of interest via one or more covalent bonds. A labile linkage contains a labile bond. A linkage may optionally include a spacer that increases the distance between the two joined atoms. A spacer may further add flexibility and/or length to the linkage. Spacers may include, but are not be limited to, alkyl groups, alkenyl groups, alkynyl groups, aryl groups, aralkyl groups, aralkenyl groups, and aralkynyl groups; each of which can contain one or more heteroatoms, heterocycles, amino acids, nucleotides, and saccharides. Spacer groups are well known in the art and the preceding list is not meant to limit the scope of the description.

Targeting groups and linking groups include or consist of, but are not limited to, the compounds represented by the structures shown in Table 4. In some of the targeting group and linking group structures shown, the RNAi trigger is shown and denoted by Trigger, RNA, R, or R1 or R2 (i.e. Trigger, RNA or R1 or R2 each comprises the RNAi trigger). In some embodiments, the RNAi trigger is linked directly to a targeting group or linking group. In other embodiments, the RNAi trigger is linked to a targeting group or linking group via a linker. For example, with respect to (Alk-C6-Ser), (Alk-PEG5-Ser), and (Alk-PEG13-Ser), one of R1 and R2 comprises the RNAi trigger and the other can be a hydrogen. With respect to linkers (C3), (C12), (Sp9), (Sp18), (Spermine), (C6-SS-C6), one of R1 or R2 comprises the RNAi trigger and the other can be a hydrogen, reactive group, targeting group, linking group, alkyl group, or substituted alkyl group.

TABLE 4

Structures representing, vpdT, targeting groups and linking groups.

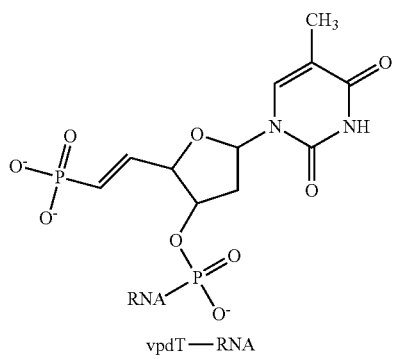

vpdT—RNA

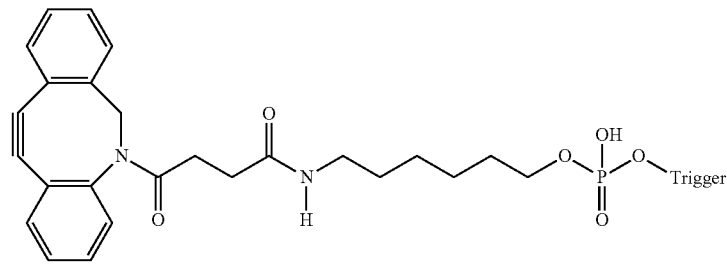

(Alk-C6)—Trigger

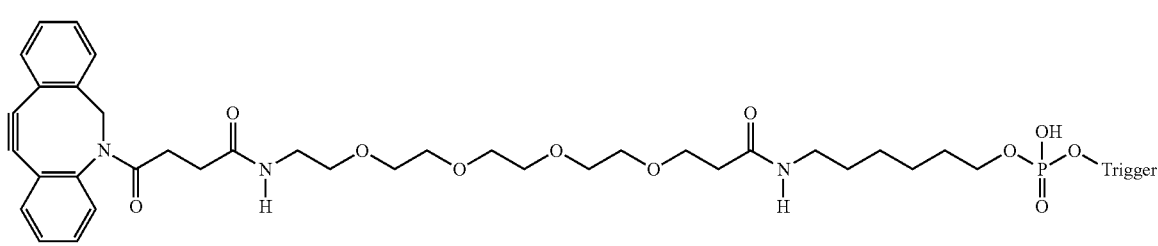

(Alk-PEG4-C6)—Trigger

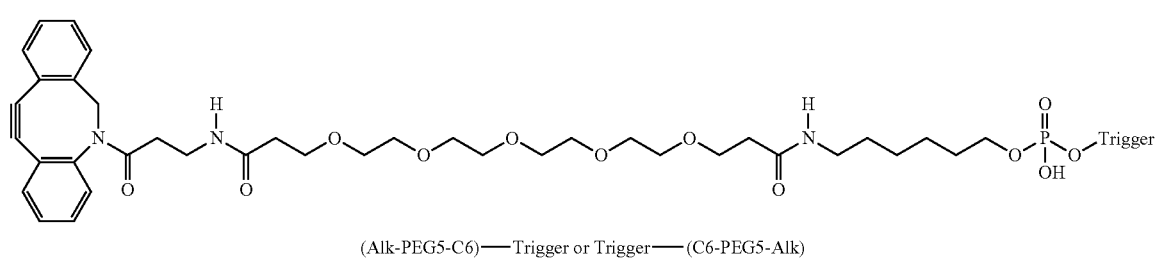

(Alk-PEG5-C6)—Trigger or Trigger—(C6-PEG5-Alk)

TABLE 4-continued
Structures representing, vpdT, targeting groups and linking groups.
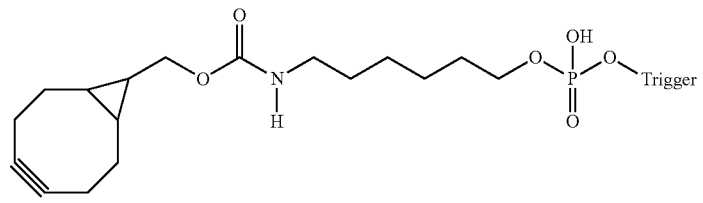
(Alk-BC9-C6)—Trigger
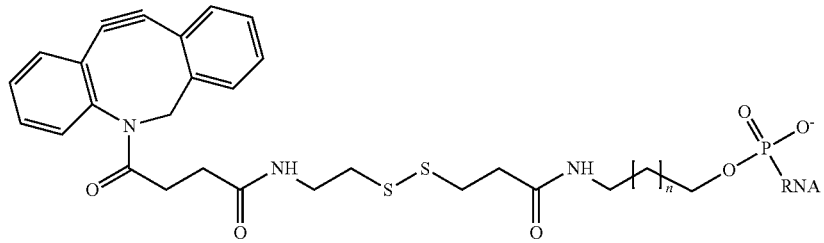
(Alk-SS-C6)—RNA, (n = 1-10), In some embodiments, n = 4
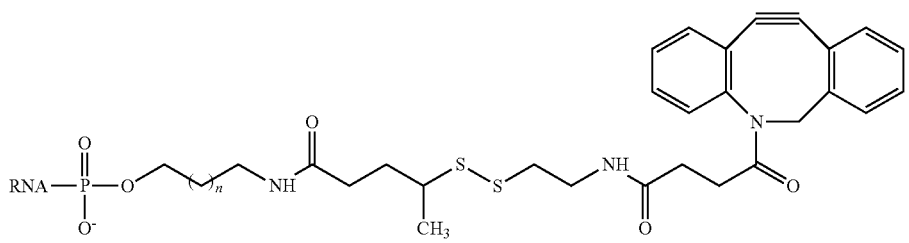
RNA—(C6-SS-Alk-Me) or ((Me-Alk-SS-C6)—RNA; (n = 1-10), In some embodiments, n = 4.
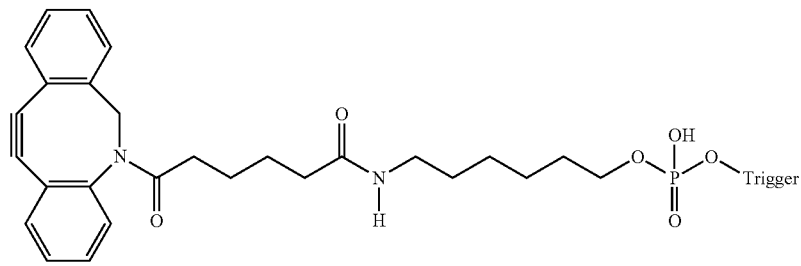
(Alk-C6-C6)—Trigger or Trigger—(C6-C6-Alk)
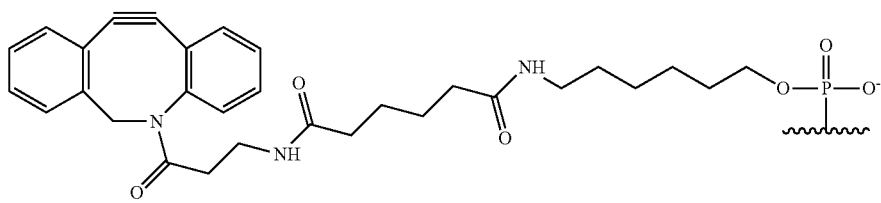
(Alk-NHCO-C6)
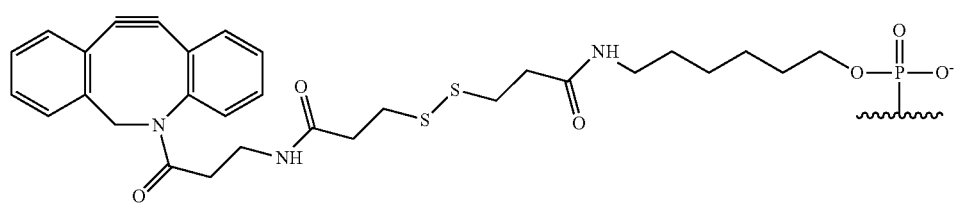
(Alk-NHCO-SS-C6)

TABLE 4-continued
Structures representing, vpdT, targeting groups and linking groups.
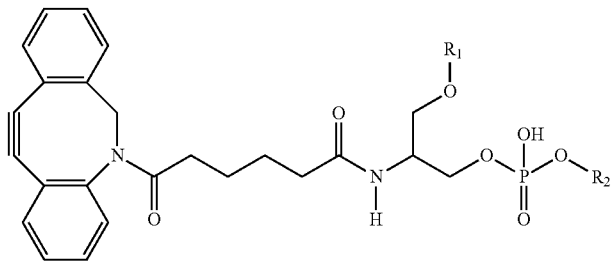
(Alk-C6-Ser)—RNA or RNA—(Ser-C6-Alk), RNA is R1 or R2
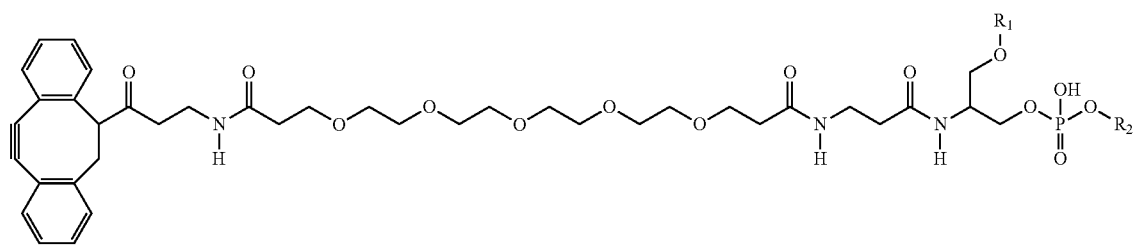
(Alk-PEG5-Ser)—RNA, RNA is R1 or R2
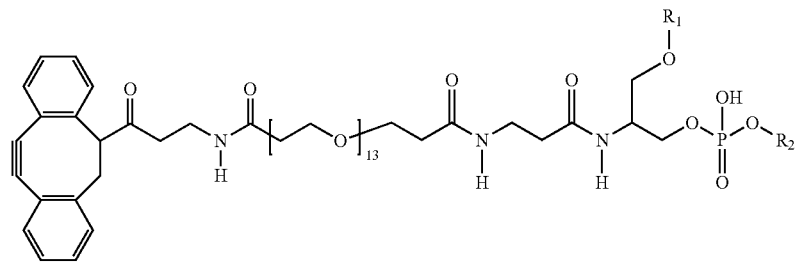
(Alk-PEG13-Ser)—RNA, RNA is R1 or R2
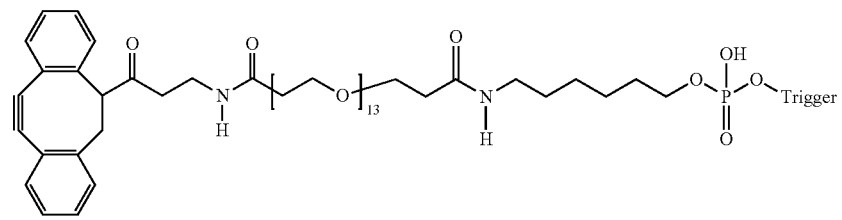
(Alk-PEG13-C6)—Trigger
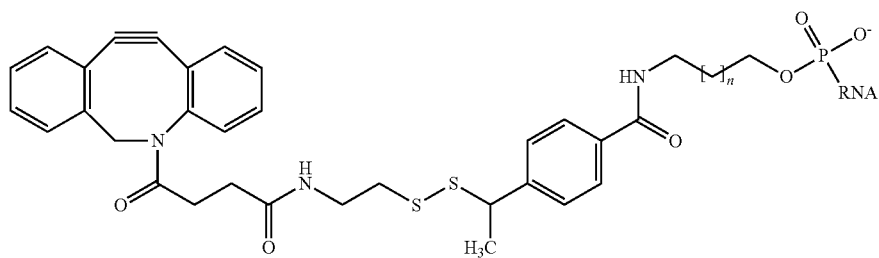
RNA—(C6-SMPT-Alk), n = 1-10, In some embodiments, n = 4

TABLE 4-continued
Structures representing, vpdT, targeting groups and linking groups.
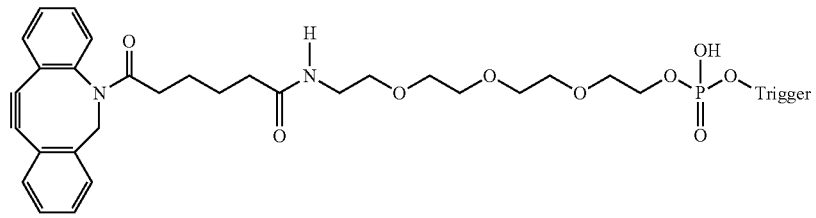
(DBCO-TEG)—Trigger
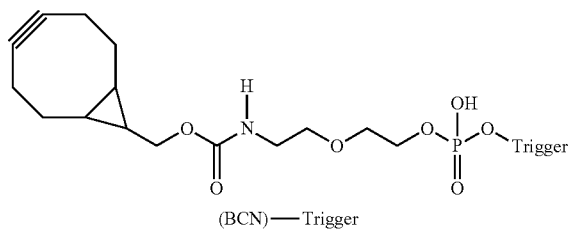
(BCN)—Trigger
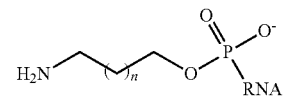
(NH$_2$-C6)—RNA, n = 1-10, In some embodiments, n = 4.
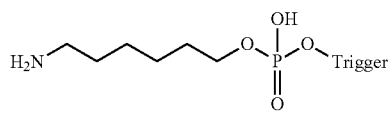
(NH2-C6)—Trigger or Trigger—(C6-NH2)
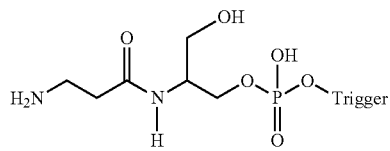
(NH2-Ser)—Trigger or Trigger—(Ser-NH2)
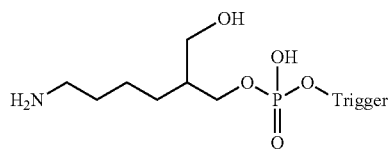
(NH2-C7)—Trigger
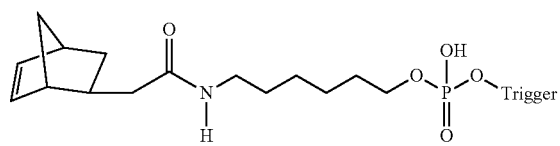
(Norbornene-C6)—Trigger
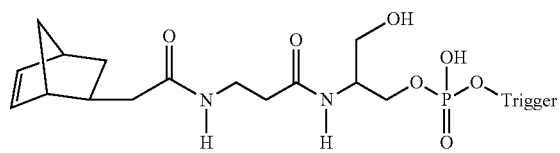
(Norbornene-Ser)—Trigger TABLE 4-continued
Structures representing, vpdT, targeting groups and linking groups.
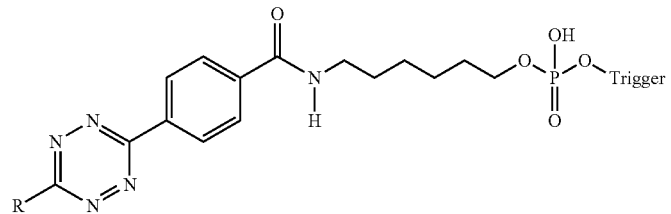
R = CH₃, H
(TetZ-C6)—Trigger
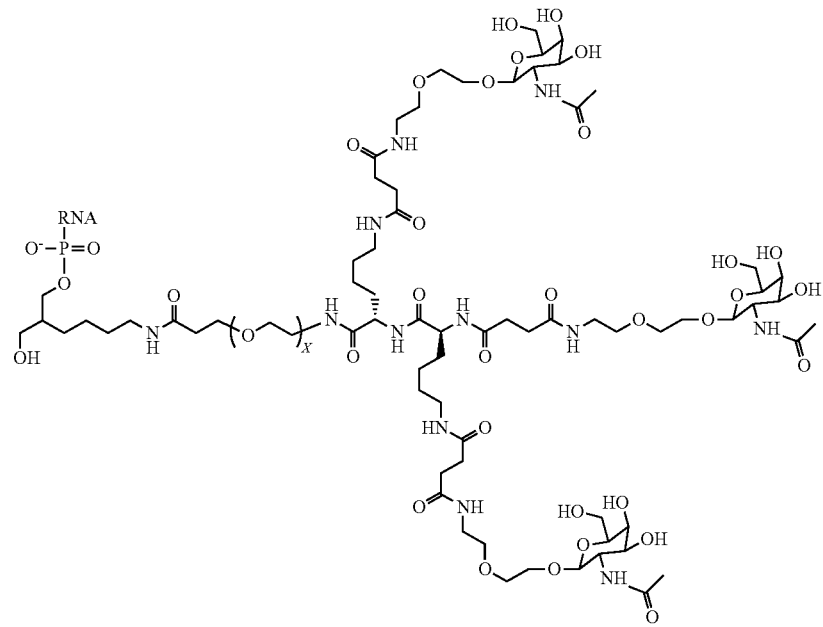
RNA—(NAG3), x = 1-10, In some embodiments, x = 8.
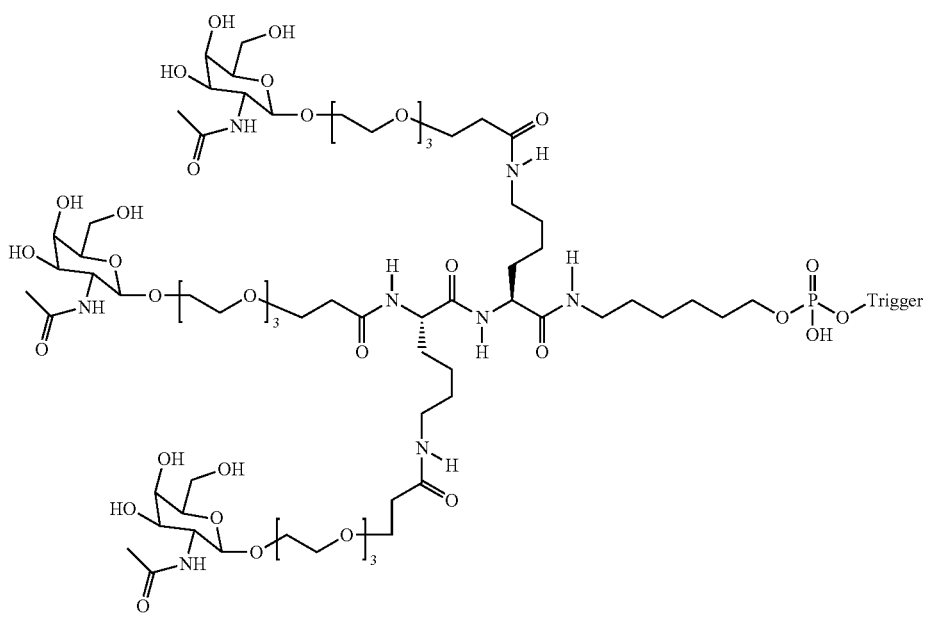
(NAG3-C6)—Trigger or Trigger—(C6-NAG3)

TABLE 4-continued
Structures representing, vpdT, targeting groups and linking groups.
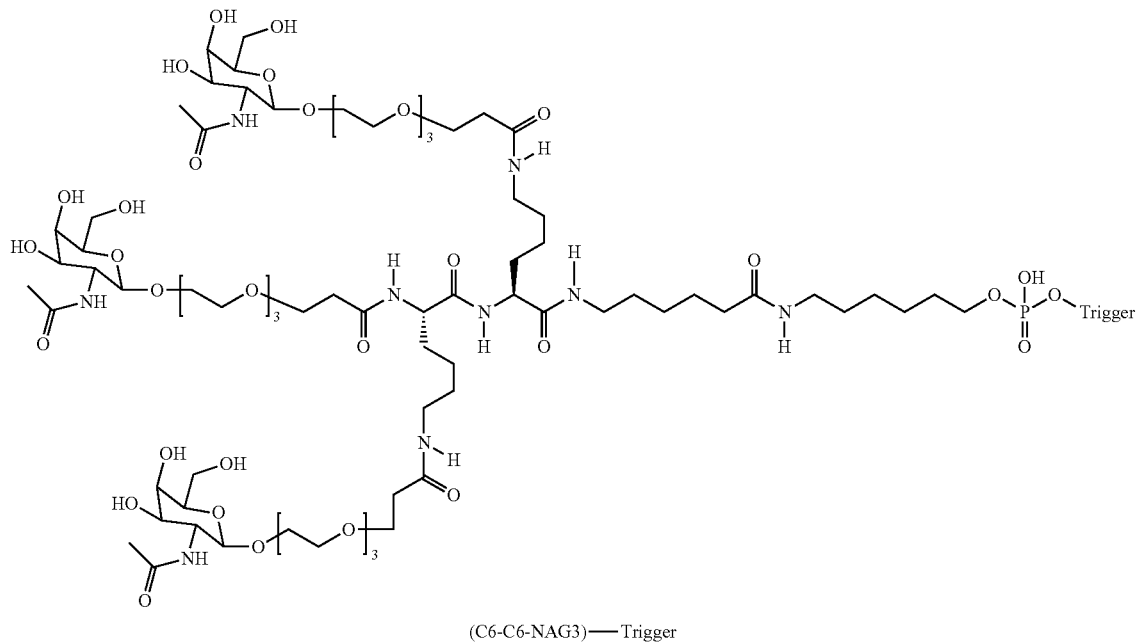
(C6-C6-NAG3)—Trigger
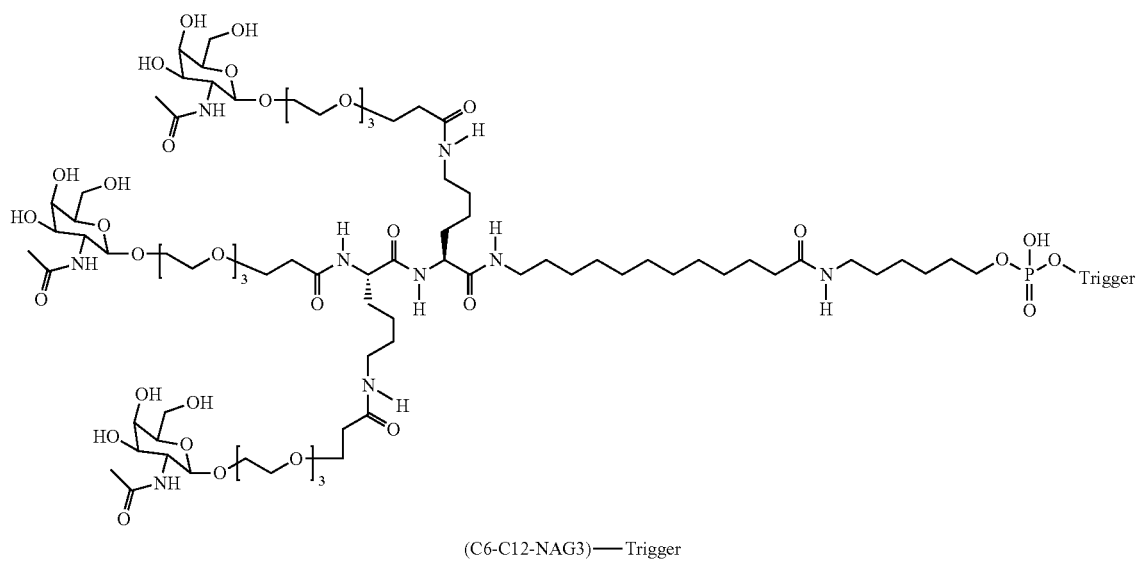
(C6-C12-NAG3)—Trigger TABLE 4-continued
Structures representing, vpdT, targeting groups and linking groups.
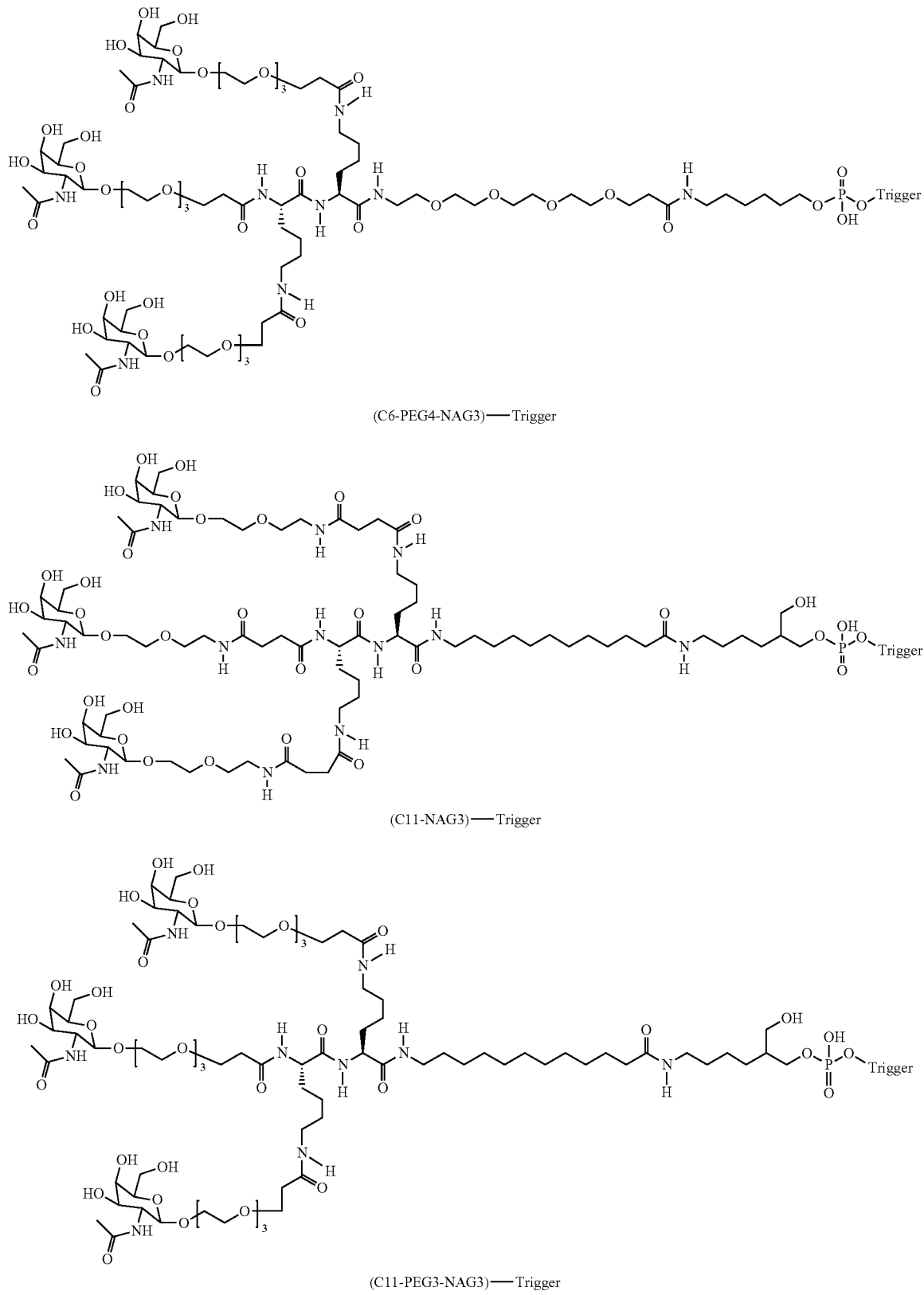
(C6-PEG4-NAG3)—Trigger
(C11-NAG3)—Trigger
(C11-PEG3-NAG3)—Trigger TABLE 4-continued
Structures representing, vpdT, targeting groups and linking groups.
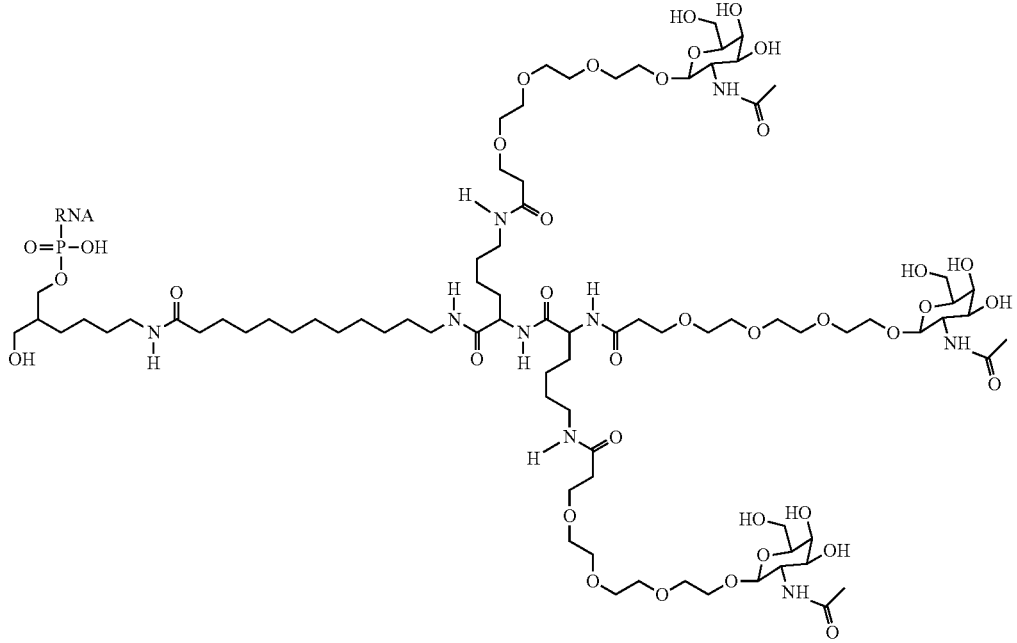
RNA—(C11-PEG3-NAG3)
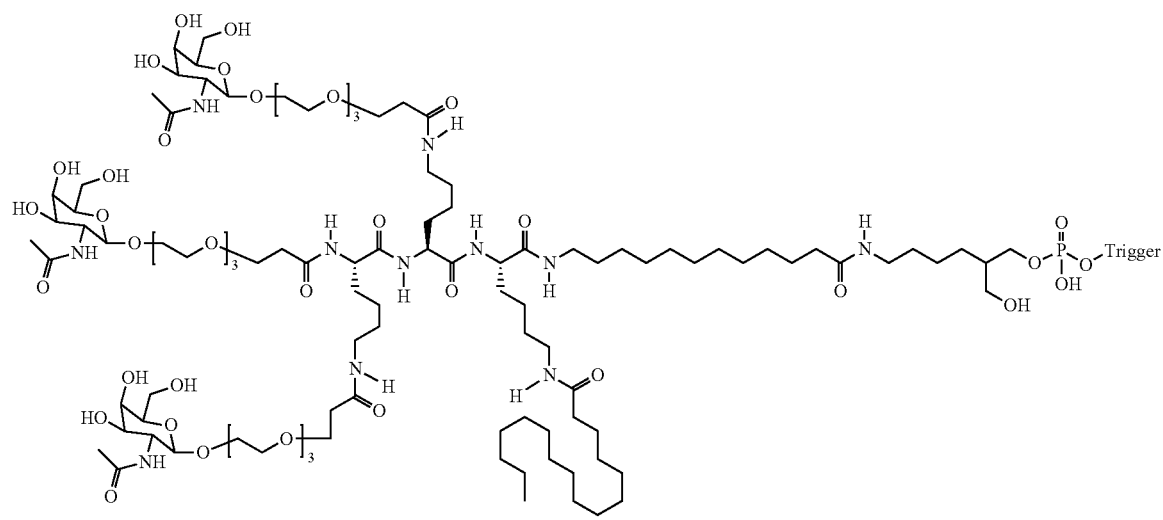
(C11-palm-NAG3)—Trigger TABLE 4-continued
Structures representing, vpdT, targeting groups and linking groups.
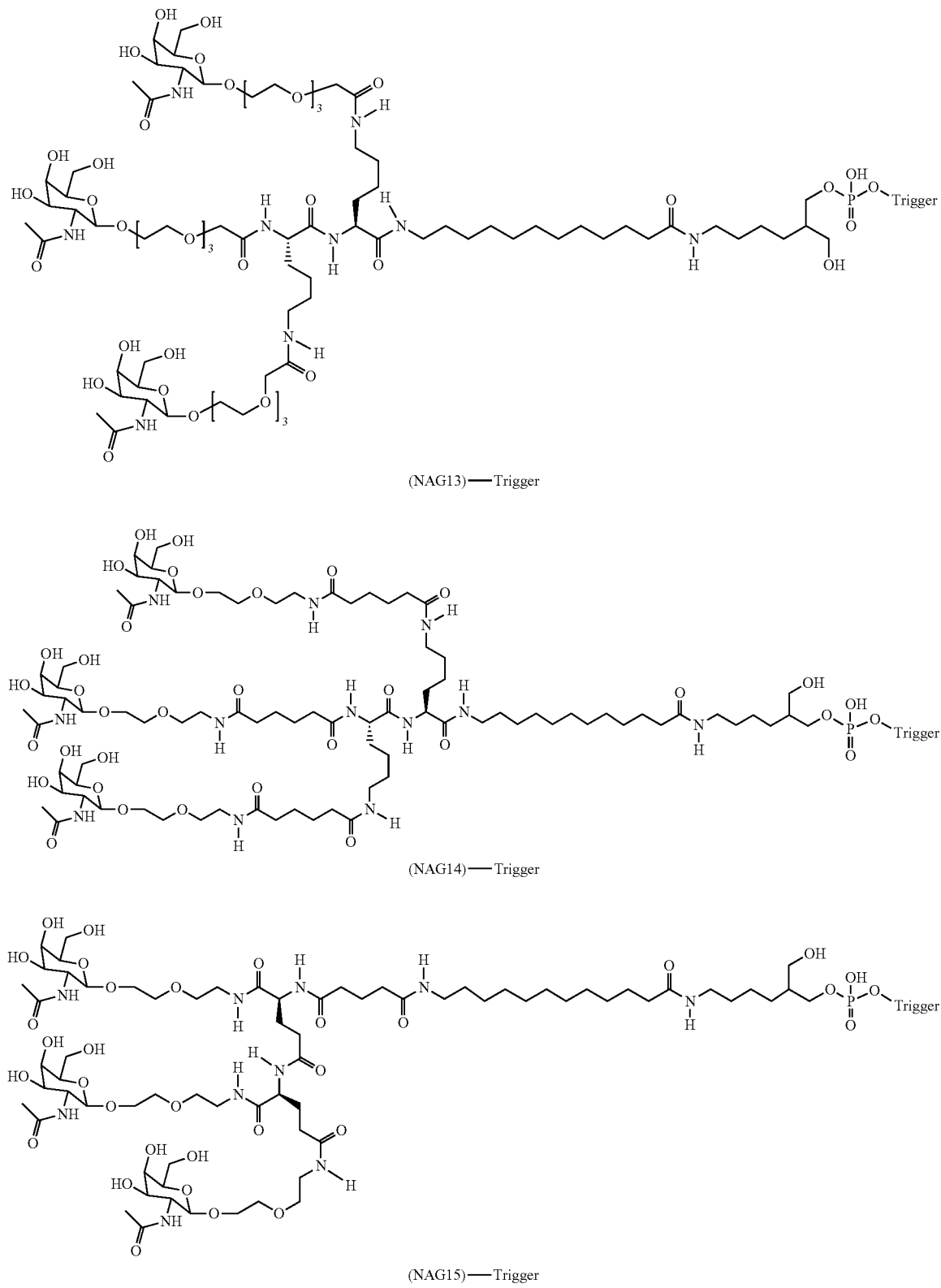
(NAG13)—Trigger
(NAG14)—Trigger
(NAG15)—Trigger TABLE 4-continued
Structures representing, vpdT, targeting groups and linking groups.
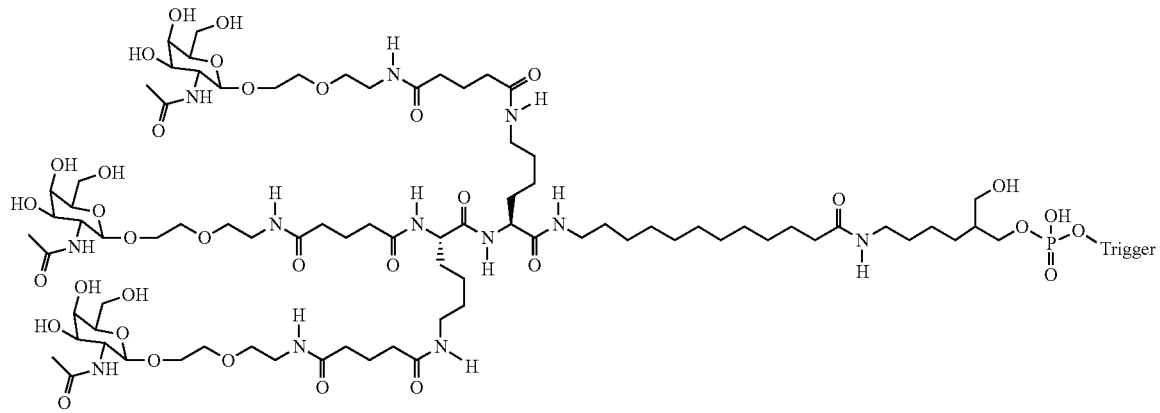
(NAG16)—Trigger
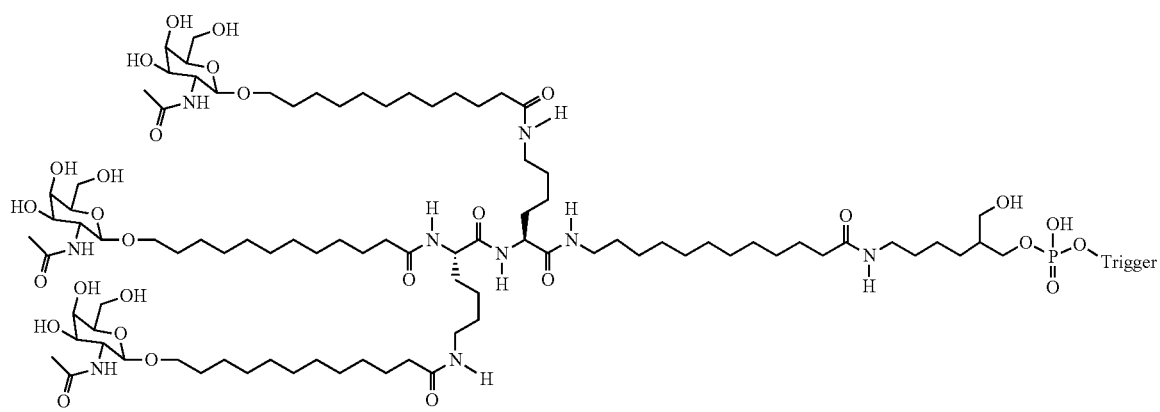
(NAG17)—Trigger
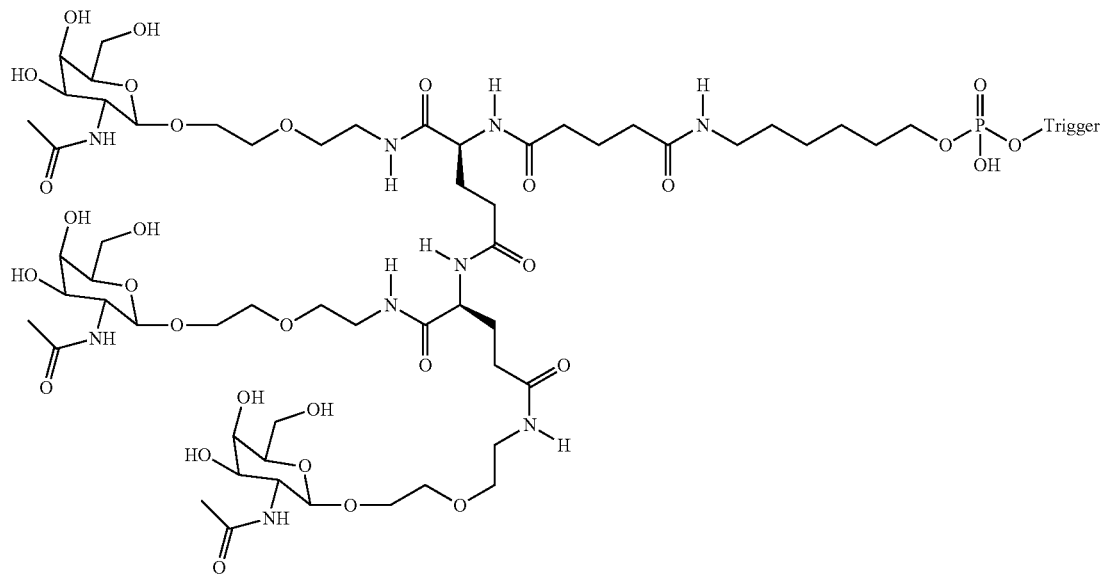
(NAG18)—Trigger TABLE 4-continued
Structures representing, vpdT, targeting groups and linking groups.
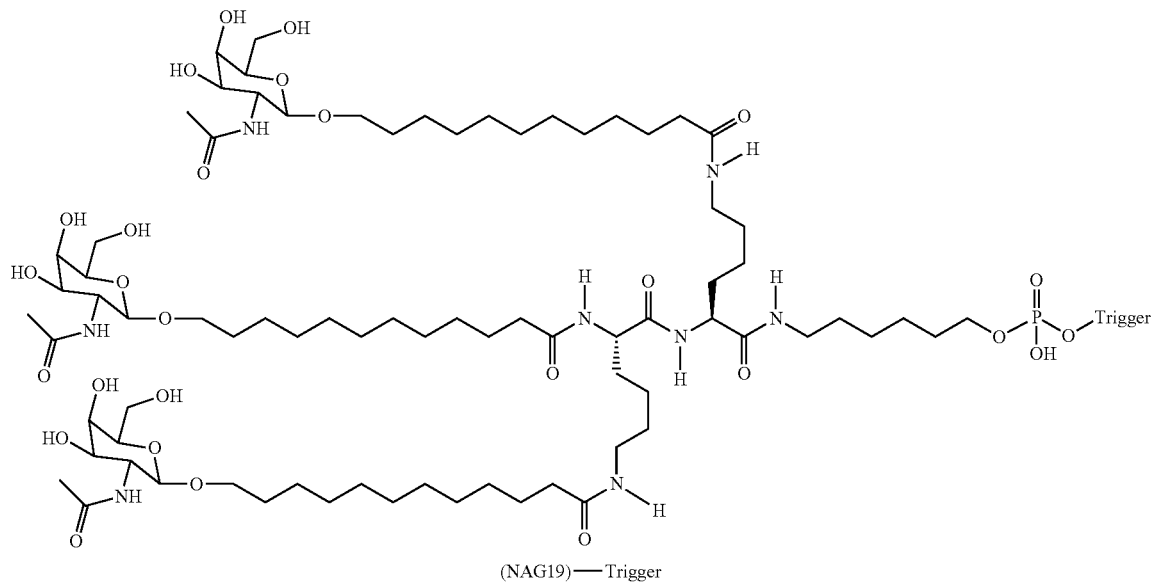
(NAG19)—Trigger
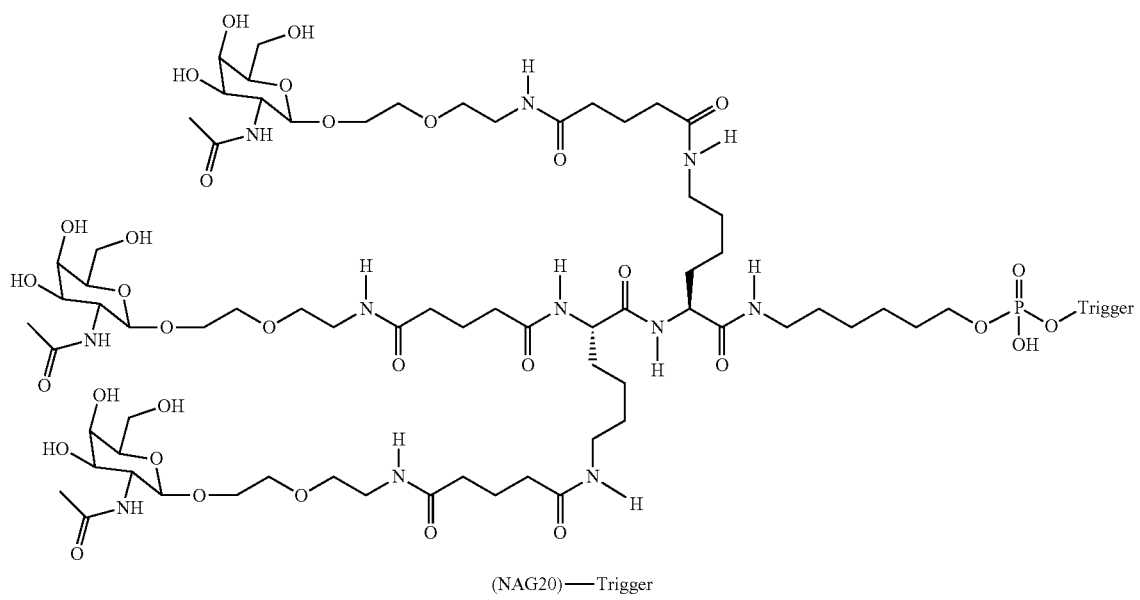
(NAG20)—Trigger TABLE 4-continued
Structures representing, vpdT, targeting groups and linking groups.
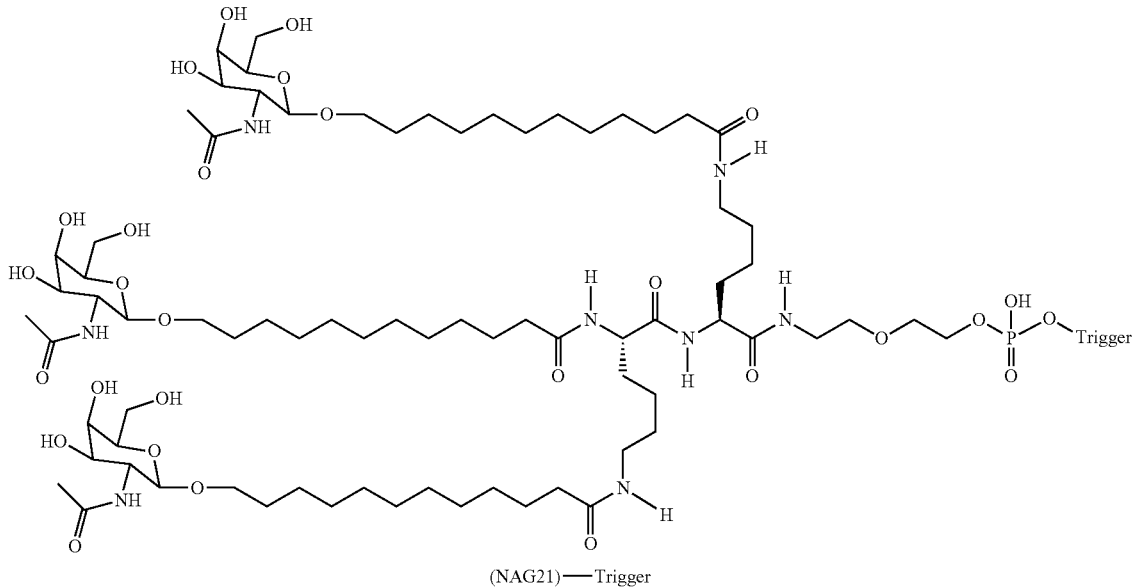
(NAG21)—Trigger
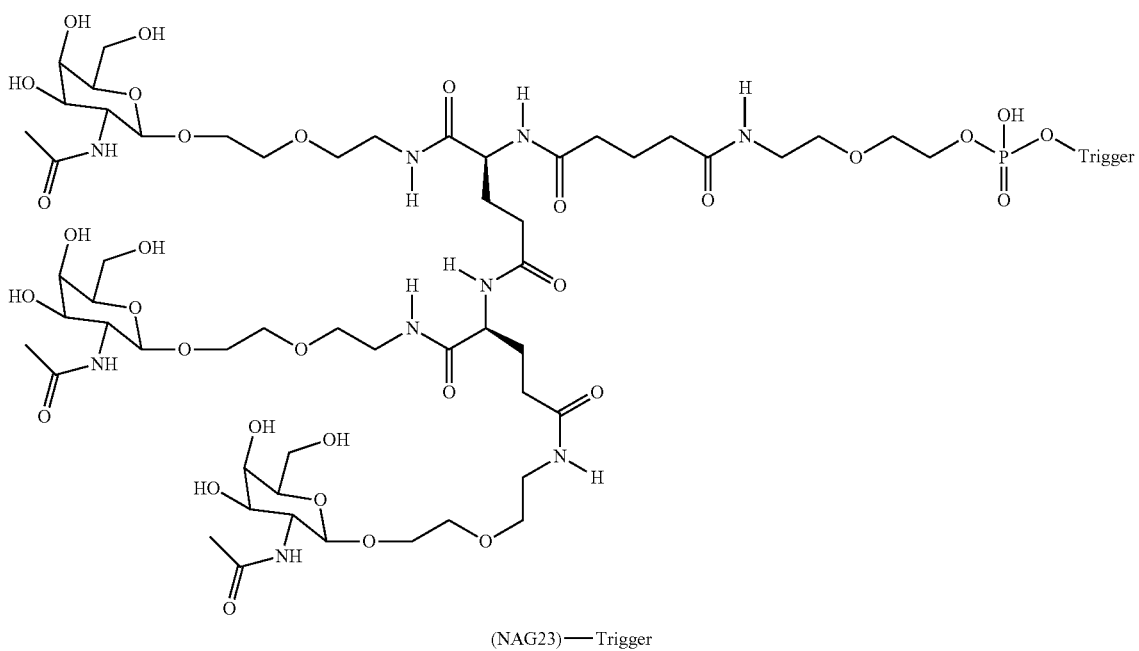
(NAG23)—Trigger TABLE 4-continued
Structures representing, vpdT, targeting groups and linking groups.
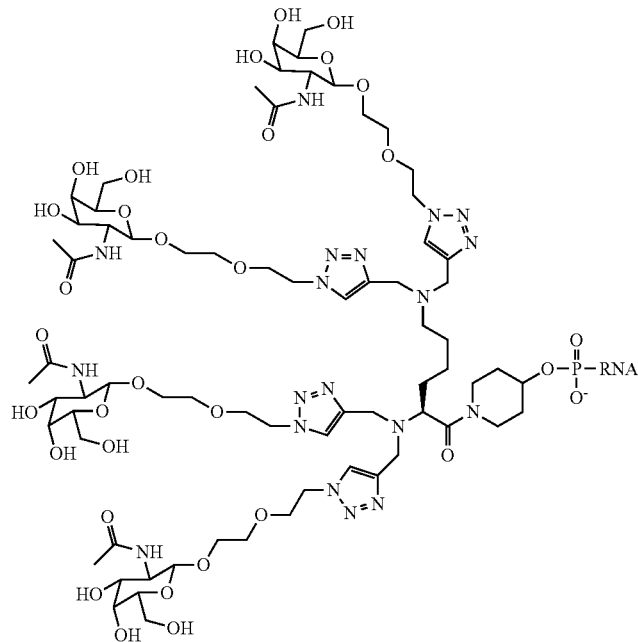
(NAG4)—RNA
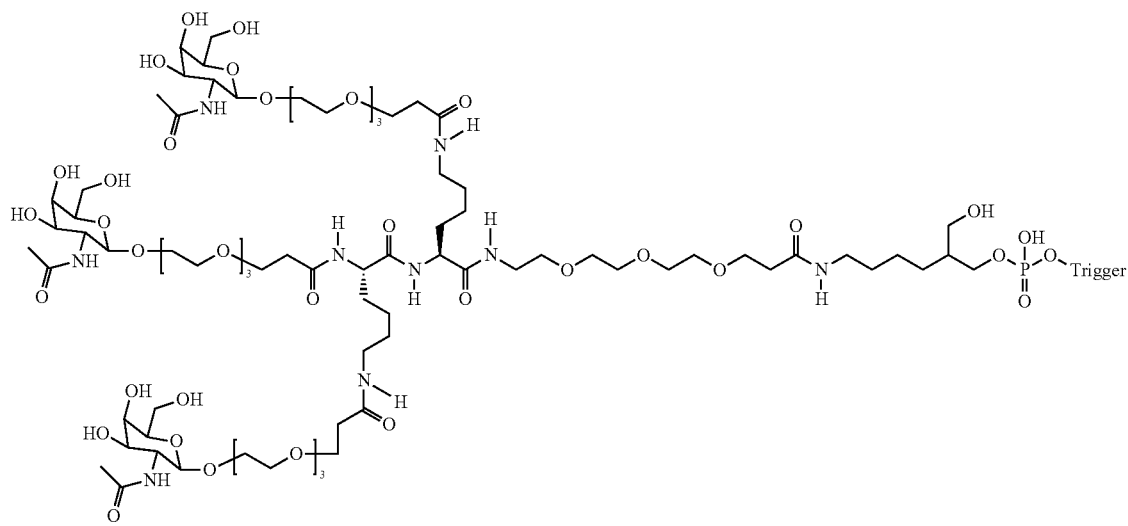
((GalNAc-PEG3-ethylene)3 bislysine-PEG3-C7 diol)—Trigger TABLE 4-continued
Structures representing, vpdT, targeting groups and linking groups.
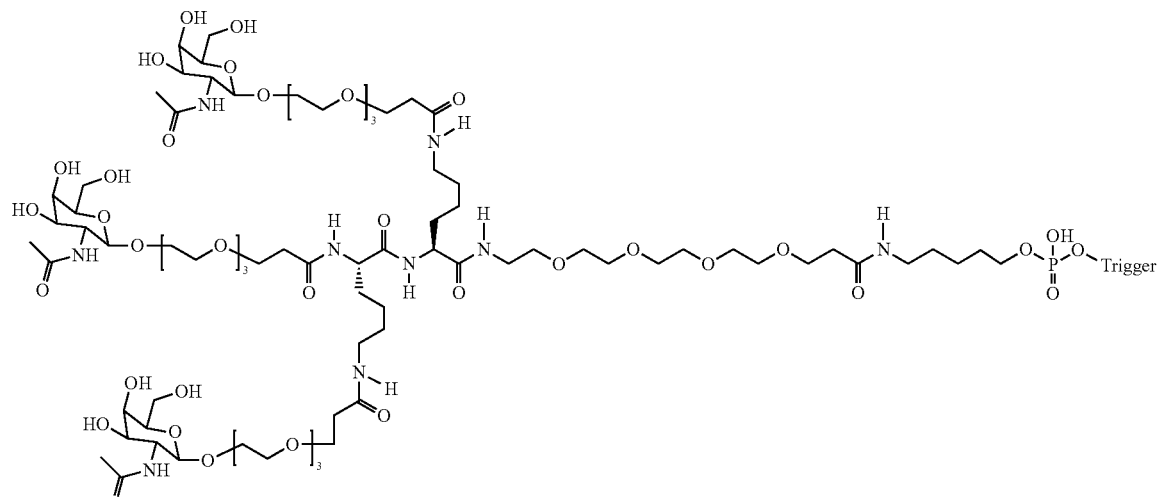
((GalNAc-PEG3-ethylene)3 bislysine-PEG3-C6)—Trigger
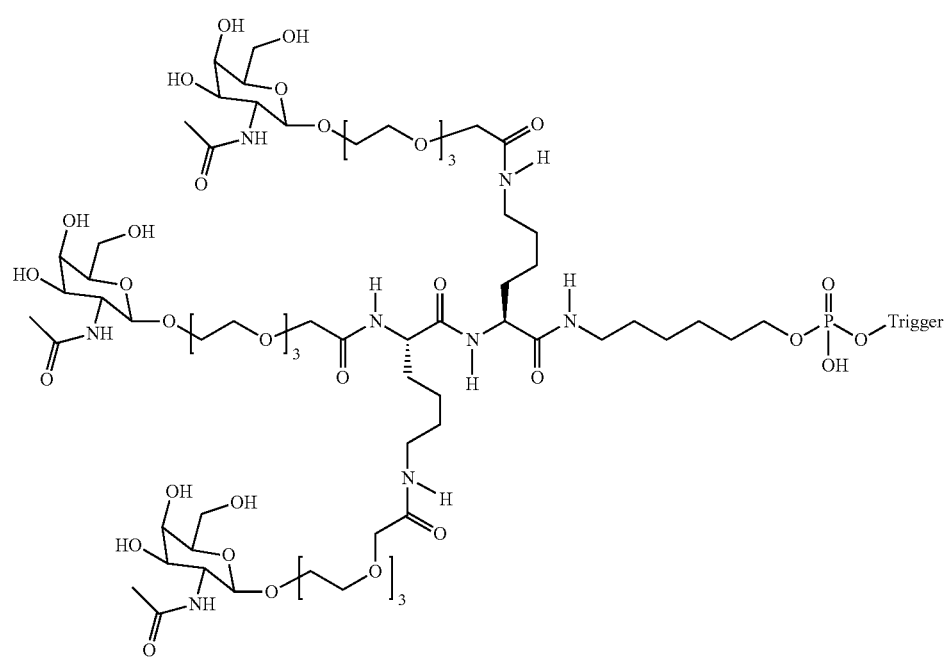
((GalNac-PEG3-methylene)3 bislysine-C6)—Trigger TABLE 4-continued
Structures representing, vpdT, targeting groups and linking groups.
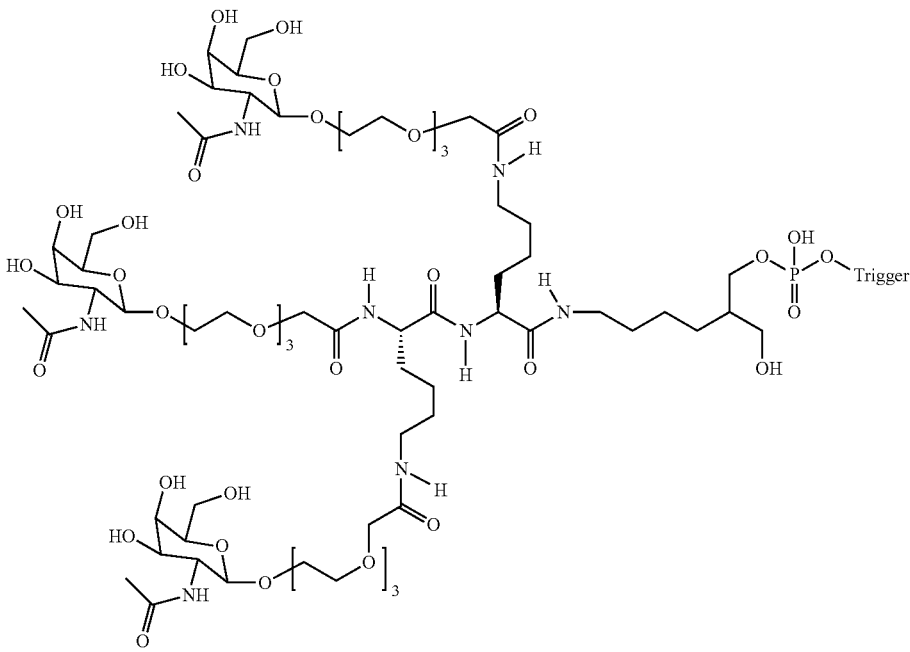
((GalNac-peg3-methylene)3 bislysine-C7 diol)—Trigger
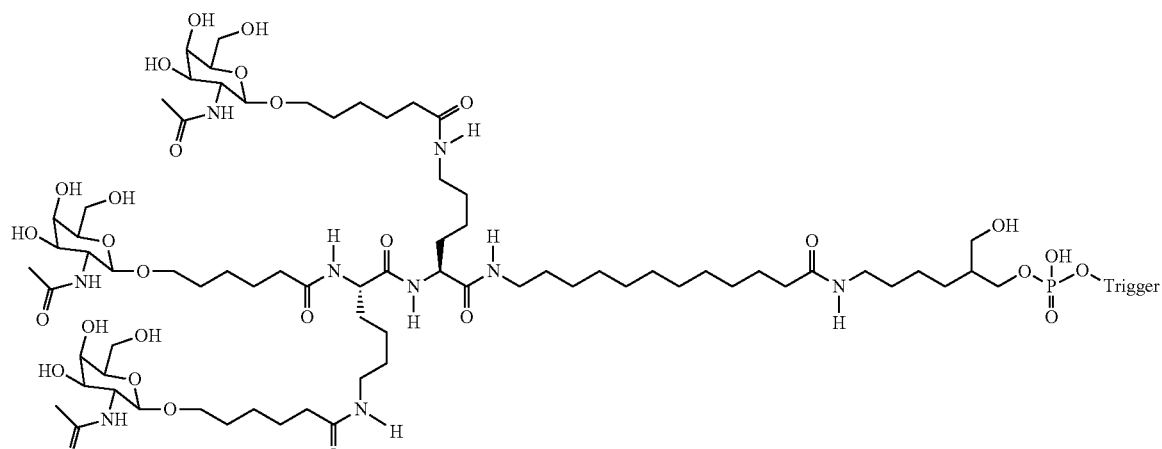
((GalNac-C6)3 bislysine-C12-C7 diol)—Trigger
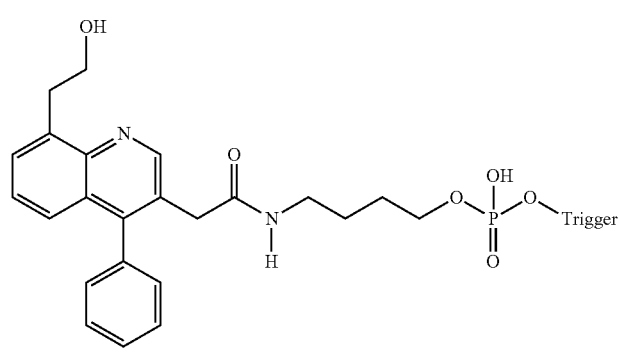
(PAZ)—Trigger TABLE 4-continued
Structures representing, vpdT, targeting groups and linking groups.
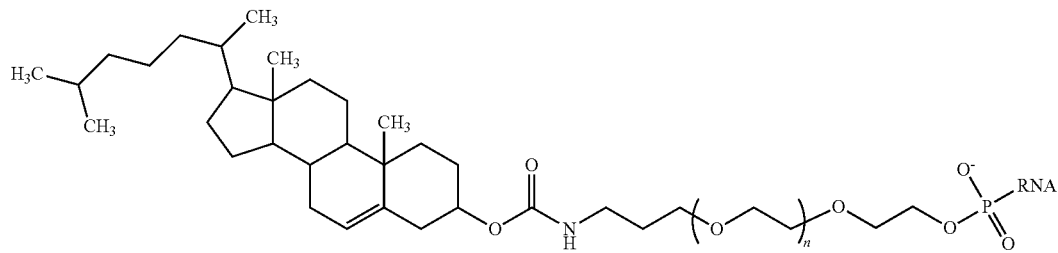
(Chol-TEG)—RNA, n = 1-10, In some embodiments, n = 2.
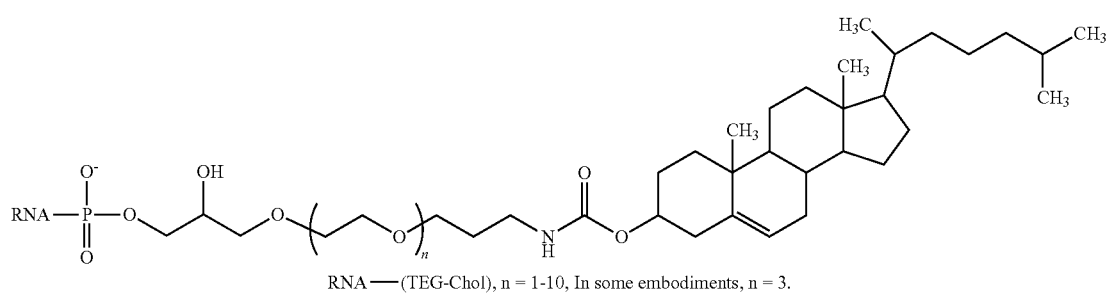
RNA—(TEG-Chol), n = 1-10, In some embodiments, n = 3.
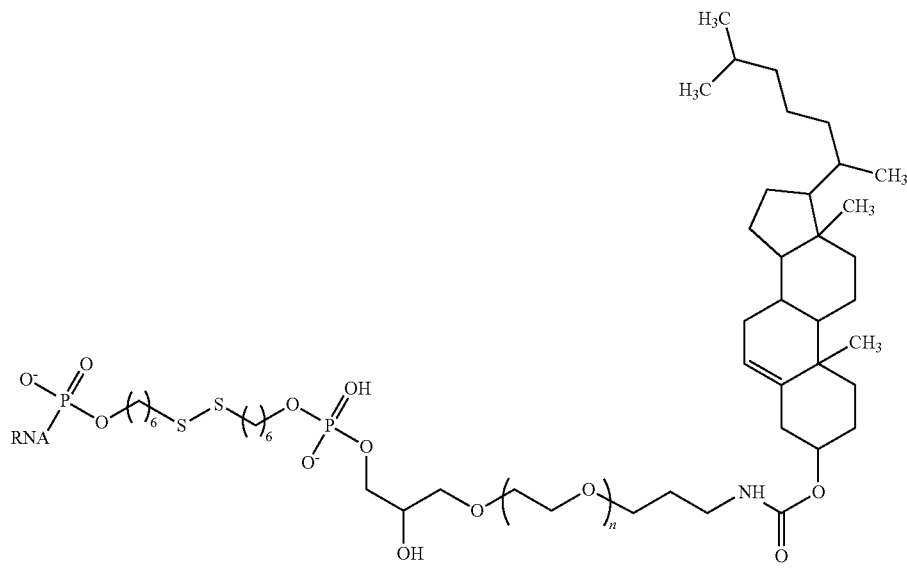
RNA—(C6-SS-C6)(TEG-Chol), n = 1-10, In some embodiments, n = 3.
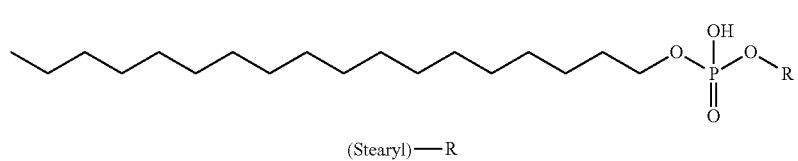
(Stearyl)—R
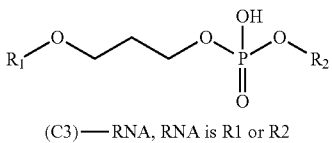
(C3)—RNA, RNA is R1 or R2

TABLE 4-continued

Structures representing, vpdT, targeting groups and linking groups.

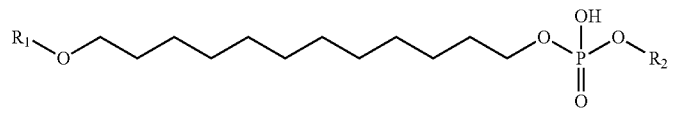

(C12)—RNA, RNA is R1 or R2

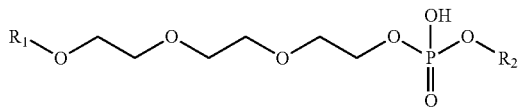

(Sp9)—RNA, RNA is R1 or R2

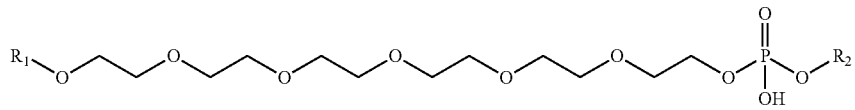

(Sp18)—RNA, RNA is R1 or R2

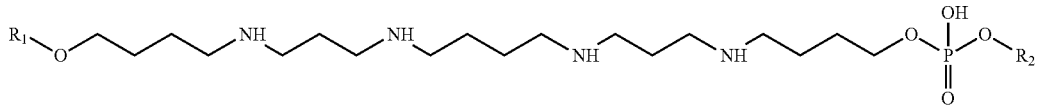

(Spermine)—RNA, RNA is R1 or R2

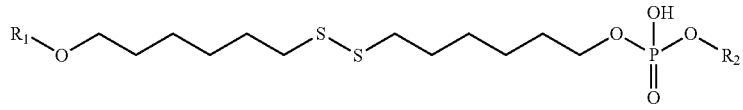

(C6-SS-C6)—RNA, RNA is R1 or R2

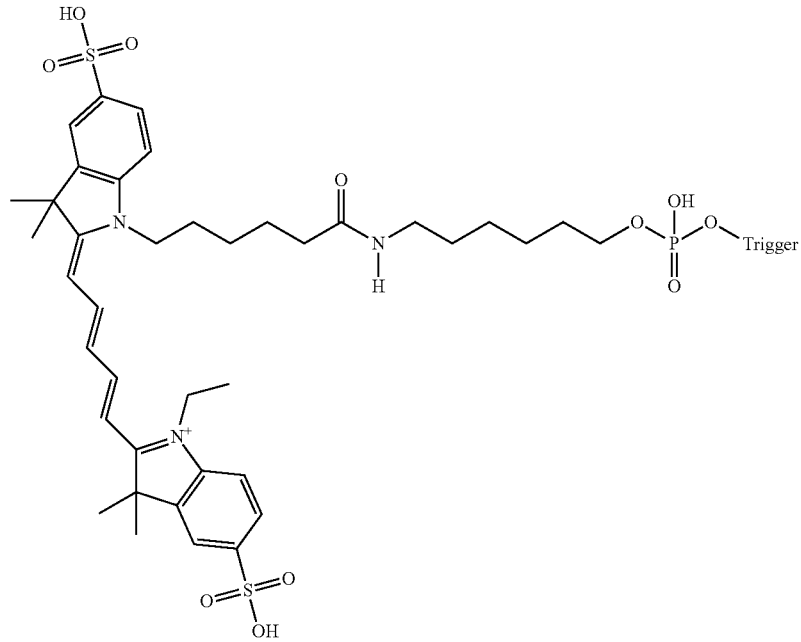

(Cy5-C6)—Trigger

In some embodiments, a delivery vehicle may be used to delivery an RNAi trigger to a cell or tissue. A delivery vehicle is a compound that improves delivery of the RNAi trigger to a cell or tissue. A delivery vehicle can include, or consist of, but is not limited to: a polymer, such as an amphipathic polymer, a membrane active polymer, a peptide, a melittin peptide, a melittin-like peptide, a lipid, or a reversibly modified polymer or peptide.

As used herein, the term "sequence" or "nucleotide sequence" refers to a succession or order of nucleobases or nucleotides, described with a succession of letters using the standard nucleotide nomenclature and the key for modified nucleotides described herein.

As used herein, and unless otherwise indicated, the term "complementary," when used to describe a first nucleotide sequence (e.g., RNAi trigger sense strand or F12 mRNA) in relation to a second nucleotide sequence (e.g. RNAi trigger antisense strand), refers to the ability of an oligonucleotide or polynucleotide comprising the first nucleotide sequence to hybridize (form base pair hydrogen bonds) and form a duplex or double helical structure under certain conditions with an oligonucleotide or polynucleotide comprising the second nucleotide sequence. Complementary sequences include Watson-Crick base pairs or non-Watson-Crick base pairs and include natural or modified nucleotides or nucleotide mimics as long as the above requirements with respect to their ability to hybridize are fulfilled. "Perfectly" or fully complementary" means that all (100%) of the bases in a contiguous sequence of a first polynucleotide will hybridize with the same number of bases in a contiguous sequence of a second polynucleotide. The contiguous sequence may comprise all or a part of a first or second nucleotide sequence. As used herein, "partial complementary" means that in a hybridized pair of nucleobase sequences, at least 70% of the bases in a contiguous sequence of a first polynucleotide will hybridize with the same number of bases in a contiguous sequence of a second polynucleotide. As used herein, "substantial complementary" means that in a hybridized pair of nucleobase sequences, at least 85% of the bases in a contiguous sequence of a first polynucleotide will hybridize with the same number of bases in a contiguous sequence of a second polynucleotide. The terms "complementary". "fully complementary" and "substantially complementary" as used herein may be used with respect to the base matching between the sense strand and the antisense strand of an RNAi trigger, or between the antisense strand of an RNAi trigger and a sequence of an F12 mRNA.

Sequence identity or complementarity is independent of modification. For the purposes of determining identity or complementarity, for example, a and Af are complementary to U (or T) and identical to A.

In some embodiments, an F12 RNAi trigger can be used to treat a subject having a disease or disorder that would benefit from reducing or inhibiting of expression of F12. In some embodiments, an F12 RNAi trigger can be used to formulate a composition for treating a disease or disorder in a subject that would benefit from reducing or inhibiting of expression of F12. The example, a subject can be administered a therapeutically effective amount of any one or more of the F12 RNAi triggers or compositions described herein. The subject also can be referred to as a patient, and can be a human or animal patient. The described F12 RNAi triggers can be used to provide a method for therapeutic treatment of diseases. Such methods typically include administration of an F12 RNAi trigger described herein to a subject.

In some embodiments, an F12 RNAi trigger can be used to inhibiting expression of F12 in a cell, group of cells, or a tissue, e.g., in a subject. In some embodiments, an F12 RNAi trigger can be used to formulate a composition for inhibiting expression of F12 in a cell, group of cells, or a tissue, e.g., in a subject. In some embodiments, a therapeutically effective amount of one type (or several different types) of F12 RNAi triggers as described herein is administered to a subject, thereby inhibiting expression of F12 in the subject (e.g., an amount effective to inhibit expression of F12 in the subject).

As used herein, the terms "silence," "reduce," "inhibit," "down-regulate," or "knockdown gene expression," when referring to an F12 gene, mean that the expression of the gene, as measured by the level of RNA transcribed from the gene or the level of polypeptide, protein, or protein subunit translated from the mRNA in a cell, group of cells, or tissue, in which the F12 gene is transcribed, is reduced when the cell, group of cells, or tissue, is treated with the described F12 RNAi triggers as compared to a second cell, group of cells, or tissue that has or have not been so treated or compared to the same cell, group of cells, or tissue, prior to administration of the F12 RNAi trigger.

In some embodiments, the F12 RNAi triggers described herein are used to treat a subject having a disease or disorder that would benefit from reduction or inhibition in F12 expression. Treatment of a subject that would benefit from a reduction and/or inhibition of F12 gene expression includes therapeutic and/or prophylactic treatment. Representative diseases are those associated with angioedema, including but not limited to: hereditary angioedema (HAE), acquired angioedema (AAE), including but not limited to ACE inhibitor associated angioedema, allergic angioedema, nonhistaminergic angioedema (INAE), idiopathic angioedema, thrombosis, venous thromboembolism (VTE), thrombotic occlusive disease, including but not limited to peri-operative venous occlusive disease prophylaxis, treatment and prevention of venous occlusive disease such as deep venous thrombosis or pulmonary embolism, and treatment or prevention of arterial thromboembolic disease.

In some embodiments, pharmaceutical compositions comprising at least one of the described F12 RNAi triggers are contemplated. These pharmaceutical compositions are useful in the inhibition of the expression of the F12 gene in a cell, a tissue, or an organism. In some embodiments, the described pharmaceutical compositions are used to treat a subject having a disease or disorder that would benefit from reduction or inhibition in F12 expression. In some embodiments, the described pharmaceutical compositions are used to treat a subject at risk of developing a disease or disorder that would benefit from reduction or inhibition in F12 expression. Diseases and/or disorder that would benefit from reduction or inhibition in F12 expression may be selected from the list comprising: angioedema, HAE, AAE, allergic angioedema, INAE, idiopathic angioedema, thrombosis, VTE, thrombotic occlusive disease, venous occlusive disease, and arterial thromboembolic disease. In some embodiments, the subject is a mammal, including, but not limited to, a human patient. In some embodiments, the method comprises administering a composition comprising an F12 RNAi trigger molecule described herein to a mammal to be treated. The pharmaceutical compositions described above may also comprise a one or more pharmaceutically acceptable excipients (including vehicles, carriers, diluents, and/or delivery polymers).

As used herein, a "pharmaceutical composition" comprises a pharmacologically effective amount of at least one RNAi trigger and one or more a pharmaceutically acceptable excipients. Pharmaceutically acceptable excipients (excipients) are substances other than the Active Pharmaceutical ingredient (API, therapeutic product, e.g., RNAi trigger) that have been appropriately evaluated for safety and are intentionally included in the drug delivery system. Excipients do not exert or are not intended to exert a therapeutic effect at the intended dosage. Excipients may act to a) aid in processing of the drug delivery system during manufacture, b) protect, support or enhance stability, bioavailability or patient acceptability of the API, c) assist in product identification, and/or d) enhance any other attribute of the overall safety, effectiveness, of delivery of the API during storage or use. A pharmaceutically acceptable excipient may or may not be an inert substance.

Excipients include, but are not limited to: absorption enhancers, anti-adherents, anti-foaming agents, anti-oxidants, binders, binders, buffering agents, carriers, coating agents, colors, delivery enhancers, dextran, dextrose, diluents, disintegrants, emulsifiers, extenders, fillers, flavors, glidants, humectants, lubricants, oils, polymers, preservatives, saline, salts, solvents, sugars, suspending agents, sustained release matrices, sweeteners, thickening agents, tonicity agents, vehicles, water-repelling agents, and wetting agents.

The pharmaceutical compositions can contain other additional components commonly found in pharmaceutical compositions. Such additional components can include, but are not limited to: anti-pruritics, astringents, local anesthetics, or anti-inflammatory agents (e.g., antihistamine, diphenhydramine, etc.). It is also envisaged that cells, tissues or isolated organs that express or comprise the herein defined RNAi triggers may be used as "pharmaceutical compositions". As used herein, "pharmacologically effective amount," "therapeutically effective amount," or simply "effective amount" refers to that amount of an RNAi trigger to produce the intended pharmacological, therapeutic or preventive result.

In other embodiments, the F12 RNAi triggers are useful for treating, preventing, or managing clinical presentations associated with angioedema, hereditary angioedema (HAE), acquired angioedema (AAE), allergic angioedema, nonhistaminergic angioedema (INAE), idiopathic angioedema, thrombosis, venous thromboembolism (VTE), thrombotic occlusive disease, venous occlusive disease, and arterial thromboembolic disease. Said methods comprise administering to a subject in need of such treatment, prevention or management a therapeutically or prophylactically effective amount of one or more of the F12 RNAi triggers described herein. In some embodiments, the subject is a mammal, including, but not limited to, a human patient. In some embodiments, the method comprises administering a composition comprising an F12 RNAi trigger molecule described herein to a mammal to be treated.

In some embodiments, the described F12 RNAi triggers and methods of using such F12 RNAi triggers are used to treat or prevent at least one symptom in a subject having a disease or disorder that would benefit from reduction or inhibition in F12 expression. The subject is administered a therapeutically effective amount of any one or more of the described RNAi triggers thereby treating the symptom. The subject is administered a prophylactically effective amount of any one or more of the described RNAi triggers thereby preventing the at least one symptom.

In some embodiments, the gene expression level and/or mRNA level of F12 in a subject to whom a described F12 RNAi trigger is administered is reduced by at least about 5%, 10%, 15%, 20%, 25%, 30%, 35%, 40%, 45%, 50%, 55%, 60%, 65%, 70%, 75%, 80%, 85%, 90%, 95%, or 98% relative to the subject prior to being administered the F12 RNAi trigger or to a subject not receiving the F12 RNAi trigger. The gene expression level and/or mRNA level in the subject may be reduced in a cell, group of cells, and/or tissue of the subject. In some embodiments, the protein level of F12 in a subject to whom a described F12 RNAi trigger has been administered is reduced by at least about 5%, 10%, 15%, 20%, 25%, 30%, 35%, 40%, 45%, 50%, 55%, 60%, 65%, 70%, 75%, 80%, 85%, 90%, 95%, or 98% relative to the subject prior to being administered the F12 RNAi trigger or to a subject not receiving the F12 RNAi trigger. The protein level in the subject may be reduced in a cell, group of cells, tissue, blood, and/or other fluid of the subject. A reduction in gene expression, mRNA, or protein levels can be assessed by any methods known in the art. Reduction or decrease in F12 mRNA level and/or protein level are collectively referred to herein as a reduction or decrease in F12 or inhibiting or reducing the expression of F12.

The described F12 RNAi triggers can be combined a second therapeutic or treatment including, but not limited to: a second RNAi trigger or other RNAi agent, a small molecule drug, an antibody, an antibody fragment, and/or a vaccine.

The described RNAi triggers and pharmaceutical compositions comprising F12 RNAi triggers disclosed herein may be packaged or included in a kit, container, pack, or dispenser. The F12 RNAi triggers may be packaged in pre-filled syringes or vials.

"Introducing into a cell", when referring to an RNAi trigger, means functionally delivering the RNAi trigger into a cell. By functional delivery, it is meant that the RNAi trigger is delivered to the cell and has the expected biological activity, (e.g., sequence-specific inhibition of gene expression).

The route of administration is the path by which an RNAi trigger is brought into contact with the body. In general, methods of administering drugs and nucleic acids for treatment of a subject are well known in the art and can be applied to administration of the compositions described herein. The compounds described herein can be administered via any suitable route in a preparation appropriately tailored to the particular route. Thus, the compounds described herein can be administered by injection, for example, intravenously, intramuscularly, intracutaneously, subcutaneously, or intraperitoneally.

In some embodiments, the F12 RNAi trigger molecules or compositions described herein can be delivered to a cell, group of cells, tissue, or subject using oligonucleotide delivery technologies known in the art. In general, any suitable method recognized in the art for delivering a nucleic acid molecule (in vitro or in vivo) can be adapted for use with an F12 RNAi trigger described herein. For example, delivery can be by local administration, (e.g., direct injection, implantation, or topical administering), systemic administration, or subcutaneous, intravenous, oral, intraperitoneal, or parenteral routes, including intracranial (e.g., intraventricular, intraparenchymal and intrathecal), intramuscular, transdermal, airway (aerosol), nasal, rectal, or topical (including buccal and sublingual) administration, In certain embodiments, the compositions are administered by subcutaneous or intravenous infusion or injection.

In some embodiments, the RNAi triggers can be combined with lipids, nanoparticles, polymers, liposomes, micelles, DPCs or other delivery systems available in the art. The RNAi triggers can also be chemically conjugated to targeting groups, lipids (including, but not limited to cholesterol and cholesteryl derivatives), nanoparticles, polymers, liposomes, micelles, DPCs (see e.g., WO 2000/053722, WO 2008/0022309, WO 2011/104169, and WO 2012/083185, each of which is incorporated herein by reference), or other delivery systems available in the art.

In some embodiments, an RNAi trigger can be conjugated to a delivery polymer. In some embodiments, the delivery polymer is a reversibly masked/modified amphipathic membrane active polyamine.

In some embodiments, an F12 RNAi trigger-targeting group conjugate can be co-administered with a melittin-like peptide (MLP) delivery peptide (e.g., an active excipient). By co-administered it is meant that the F12 RNAi trigger and the delivery peptide are administered to the subject such that both are present in the subject at the same time. The F12 RNAi trigger-targeting group conjugate and the delivery peptide may be administered simultaneously or they may be delivered sequentially. For simultaneous administration, the F12 RNAi trigger-targeting group conjugate and the delivery peptide can be mixed prior to administration. For sequential administration, either the F12 RNAi trigger-group moiety conjugate or the delivery peptide can be administered first.

In some embodiments, pharmaceutical compositions for delivering an F12 RNAi trigger to a liver cell in vivo are described. Such pharmaceutical compositions can include or consist of: a) an F12 RNAi trigger conjugated to a hydrophobic group containing at least 20 carbon atoms (RNAi trigger-conjugate), such as a cholesterol and b) an MLP delivery polymer. The MLP delivery polymer and the RNAi trigger-conjugate can be synthesized separately and may be supplied in separate containers or a single container. In some embodiments, the F12 RNAi trigger is not conjugated to the delivery peptide.

Melittin-like peptide (MLP) as used herein, is a small amphipathic membrane active peptide, comprising about 23 to about 32 amino acids derived from the naturally occurring bee venom peptide, melittin, as described in WO 2012/083185. The naturally occurring melittin contains 26 amino acids and is predominantly hydrophobic on the amino terminal end and predominantly hydrophilic (cationic) on the carboxy terminal end. In some embodiments, the MLP described herein is isolated from a biological source. In other embodiments, the MLP is synthetic. A MLP synthetic polymer can be formulated or manufactured by a chemical process. As used herein, MLP encompasses the naturally occurring bee venom peptides of the melittin family that can be found in, for example, venom of the species: *Apis florea, Apis mellifera, Apis cerana, Apis dorsata, Vespula maculifrons, Vespa magnifica, Vespa velutina, Polistes* sp. HQL-2001, and *Polistes hebraeus*. As used herein, MLP also encompasses synthetic peptides having amino acid sequence identical to or similar to naturally occurring melittin peptides. Examples of MLP amino acid sequences include those provided in Table 5. In some embodiments, MLP comprises: Leu-Ile-Gly-Ala-Ile-Leu-Lys-Val-Leu-Ala-Thr-Gly-Leu-Pro-Thr-Leu-Ile-Ser-Trp-Ile-Lys-Asn-Lys-Arg-Lys-Gln (SEQ ID 2234).

TABLE 5

MLP peptide sequences.

| SEQ ID NO. | Melittin Sequence | Name |
|---|---|---|
| 2228 | GIGAILKVLATGLPTLISWIKNKRKQ | *Apis florea* |
| 2229 | AIGAILKVLATGLPTLISWIKNKRKQ | G1A |
| 2230 | CIGAILKVLATGLPTLISWIKNKRKQ | G1C |
| 2231 | FIGAILKVLATGLPTLISWIKNKRKQ | G1F |
| 2232 | HIGAILKVLATGLPTLISWIKNKRKQ | G1H |
| 2233 | IIGAILKVLATGLPTLISWIKNKRKQ | G1I |
| 2234 | LIGAILKVLATGLPTLISWIKNKRKQ | G1L |
| 2235 | NleIGAILKVLATGLPTLISWIKNKRKQ | G1Nle |
| 2236 | VIGAILKVLATGLPTLISWIKNKRKQ | G1V |
| 2237 | WIGAILKVLATGLPTLISWIKNKRKQ | G1W |
| 2238 | YIGAILKVLATGLPTLISWIKNKRKQ | G1Y |
| 2239 | GIGAILKVLACGLPTLISWIKNKRKQ | T11C dMel |
| 2240 | GIGAILKVLATLLPTLISWIKNKRKQ | G12L |
| 2241 | GIGAILKVLATWLPTLISWIKNKRKQ | G12W |
| 2242 | GIGAILKVLATGLPTLISWIKTKRKQ | N22T |
| 2243 | YIGAILNVLATGLPTLISWIKNKRKQ | G1Y, K7N |
| 2244 | YIGAILAVLATGLPTLISWIKNKRKQ | G1Y, K7A |
| 2245 | LIGAILSVLATGLPTLISWIKNKRKQ | G1L, K7S |
| 2246 | LIGAILRVLATGLPTLISWIKNKRKQ | G1L, K7R |
| 2247 | LIGAILHVLATGLPTLISWIKNKRKQ | G1L, K7H |
| 2248 | LIGAILKVLACGLPTLISWIKNKRKQ | G1L, T11C |

TABLE 5-continued

MLP peptide sequences.

| SEQ ID NO. | Melittin Sequence | Name |
|---|---|---|
| 2249 | LIGAILKVLATLLPTLISWIKNKRKQ | G1L, G12L |
| 2250 | YIGAILKVLATGLLTLISWIKNKRKQ | G1Y, P14L |
| 2251 | LIGAILKVLATGLPCLISWIKNKRKQ | G1L, T15C |
| 2252 | LIGAILKVLATGLPTLICWIKNKRKQ | G1L, S18C |
| 2253 | YIGAILKVLATGLPTLISAIKNKRKQ | G1Y, W19A |
| 2254 | GIGAILKVLACGLPTLISWLKNKRKQ | T11C, I20L |
| 2255 | YIGAILKVLATGLPTLISWIANKRKQ | G1Y, K21A |
| 2256 | YIGAILKVLATGLPTLISWIKNARKQ | G1Y, K23A |
| 2257 | LIGAILKVLATGLPTLISWIKNKAKQ | G1L, R24A |
| 2258 | YIGAILKVLATGLPTLISWIKNKRAQ | G1Y, K25A |
| 2259 | YIGAILKVLATGLPTLISWIKNKRKC | G1Y, Q26C |
| 2260 | LLGAILKVLACGLPTLISWIKNKRKQ | G1L, I2L, T11C |
| 2261 | LIGALLKVLACGLPTLISWIKNKRKQ | G1L, I5L, T11C |
| 2262 | YIGAILAVLATGLPTLISWIANKRKQ | G1Y, K7A, K21A |
| 2263 | YIGAILAVLATGLPTLISWIKNARKQ | G1Y, K7A, K23A |
| 2264 | LIGAILKVLACGLPTLLSWIKNKRKQ | G1L, T11C, I17L |
| 2265 | LIGAILKVLACG1PTLICWIKNKRKQ | G1L, T11C, S18C |
| 2266 | GIGAILKVLACGLPGLIGWIKNKRKQ | T11G, T15G, S18G |
| 2267 | GIGAILKVLACGLPALIAWIKNKRKQ | T11A, T15A, S18A |
| 2268 | YIGAILAVLATGLPTLISWIANARKQ | G1Y, K7A, K21A, K23A |
| 2269 | YIAAILKVLAAALATLISWIKNKRKQ | G1Y, G3A, T11A, G12A, P14A |
| 2270 | LLGALLKVLATGLPTLLSWLKNKRKQ | G1L, I2L, I5L, I17L, I20L |
| 2271 | LNleGANleLKVLATGLPTLNleSWNleKNKRKQ | G1L, I2Nle, I5Nle, I17Nle, I20Nle |
| 2272 | LVGAVLKVLATGLPTLVSWVKNKRKQ | G1L, I2V, I5V, I17V, I20V |
| 2273 | GLGALLKVLACGLPTLLSWLKNKRKQ | I2L, I5L, T11C, I17L, I20L |
| 2274 | GNleGANleLKVLACGLPTLNleSWNleKNKRKQ | I2Nle, I5Nle, T11C, I17Nle, I20Nle |
| 2275 | CEDDLLLGAILKVLATGLPTLISWIKNKRKQ | CEDDL-Mel G1L, I2L |
| 2276 | CLVVLIVVAILKVLATGLPTLISWIKNKRKQ | CLVVL-Mel G1I, I2V, G3V |
| 2277 | GIGAVLKVLTTGLPALISWIKRKRQQ | *Apis mellifera* |
| 2278 | CLIGAILKVLATGLPTLISWIKNKRKQ | C-Mel G1L |
| 2279 | CNleIGAILKVLATGLPTLISWIKNKRKQ | C-Mel G1Nle |
| 2280 | GLIGAILKVLATGLPTLISWIKNKRKQ | G-Mel G1L |
| 2281 | LLIGAILKVLATGLPTLISWIKNKRKQ | L-Mel G1L |
| 2282 | KLKLIGAILKVLATGLPTLISWIKNKRKQ | KLK-Mel G1L |
| 2283 | KLKYIGAILKVLATGLPTLISWIKNKRKQ | KLK-Mel G1Y |
| 2284 | CKLKLIGAILKVLATGLPTLISWIKNKRKQ | CKLK-Mel G1L |
| 2285 | CKLKNleIGAILKVLATGLPTLISWIKNKRKQ | CKLK-Mel G1Nle |

TABLE 5-continued

MLP peptide sequences.

| SEQ ID NO. | Melittin Sequence | Name |
|---|---|---|
| 2286 | GKLKLIGAILKVLATGLPTLISWIKNKRKQ | GKLK-Mel G1L |
| 2287 | CPANLIGAILKVLATGLPTLISWIKNKRKQ | CPAN-dMel G1L |
| 2288 | DEPLRAIGAILKVLATGLPTLISWIKNKRKQ | DEPLR-Mel G1A |
| 2289 | GIGAILKVLATGLPTLISWIKNKRKQC | Mel-Cys |
| 2290 | LIGAILKVLATGLPTLISWIKNKRKQC | G1L Mel-Cys |
| 2291 | NleIGAILKVLATGLPTLISWIKNKRKQC | G1Nle Mel-C |
| 2292 | LIGAILKVLATGLPTLISWIKNKRKQKLKC | G1L Mel-KLKC |
| 2293 | YIGAILKVLATGLPTLISWIKNKRKQPLGIAGQC | G1Y Mel-PLGIAGQC |
| 2294 | LIGAILKVLATGLPTLISWIKNKRKQKKKKK | G1L Mel-KKKKK |
| 2295 | YIGAILKVLATGLPTLISWIKNKRKQGFKGC | G1Y Mel-GFKGC |
| 2296 | CFKLIGAILKVLATGLPTLISWIKNKRKQC | CFK-G1L Mel-C |
| 2297 | FGAILKVLATGLPTLISWIKNKRKQ | G1F, I2Δ |
| 2298 | LIGAILKVLATGLPTLISWIKNK | G1L Mel (1-23) |
| 2299 | LIGAVLKVLTTGLPALISWIK | G1L, L5V, A10T, T15A Mel (1-23) |
| 2300 | LIGAVLKVLTTGLPALISWIKGE | G1L, L5V, A10T, T15A, N22G, K23E Mel (1-23) |
| 2301 | QKRKNKIWSILTPLGTALVKLIAGIL | G1L retroMel |
| 2302 | KLKQKRKNKIWSILTPLGTALVKLIAGIL | G1L retroMel-KLK |
| 2303 | GIGAVLKVLTTGLPALISWISRKKRQQ | I5V, A10T, T15A, N22R, R24K, K25R Mel-Q |
| 2304 | GIGARLKVLTTGLPR ISWIKRKRQQ | I5R, A10T, T15R, L16Δ, N22R, K25Q |
| 2305 | GIGAILKVLSTGLPALISWIKRKRQE | A10S, T15A, N22R, K25Q, Q26E |
| 2306 | GIGAVLKVLTTGLPALIGWIKRKRQQ | I5V, A10T, T15A, S18G, N22R, K25Q |
| 2307 | GIGAVLKVLATGLPALISWIKRKRQQ | I5V, T15A, N22R, K25Q |
| 2308 | GIGAVLKVLSTGLPALISWIKRKRQQ | I5V, A10S, T15A, N22R, K25Q |
| 2309 | GIGAILRVLATGLPTLISWIKNKRKQ | K7R |
| 2310 | GIGAILKVLATGLPTLISWIKRRKQ | N22R |
| 2311 | GIGAILKVLATGLPTLISWIKKKQQ | N22K, R24K, K25Q |
| 2312 | GIGAILKVLATGLPTLISWIKNKRKQGSKKKK | Mel-GSKKKK |
| 2313 | KKGIGAILKVLATGLPTLISWIKNKRKQ | KK-Mel |
| 2314 | GIGAILEVLATGLPTLISWIKNKRKQ | K7E Mel |
| 2315 | GIGAVLKVLTTGLPALISWIKRKR | I5V, T15A, N22R, 25-26Δ |
| 2316 | GIGAVLKVLTTGLPALISWIKR | I5V, T15A, N22R, 23-26Δ |
| 2317 | CIGAVLKVLTTGLPALISWIKRKRQQ | G1C, I5L, T15A, N22R |
| 2318 | QQRKRKIWSILAPLGTTLVKLVAGIG | I5V, A10T, T15A, N22R retroMel |
| 2319 | QQRKRKIWSILAPLGTTLVKLVAGIC | G1C, I5V, A10T, T15A, N22R retroMel |

TABLE 5-continued

MLP peptide sequences.

| SEQ ID NO. | Melittin Sequence | Name |
|---|---|---|
| 2320 | QQKKKKIWSILAPLGTTLVKLVAGIC | G1C, I5V, A10T, T15A, N22R, R24K retroMel |
| 2321 | QKRKNKIWSILTPLGTALVKLIAGIG | Q25K reverse Mel |
| 2322 | QQRKRKIWSILAALGTTLVKLVAGIC | G1C, I5V, A10T, P14A, T15A, N22R retroMel | dMel = Melittin peptide having D-form amino acids
Nle = norluecine

Membrane activity of the MLPs can be reversibly masked to yield MLP delivery polymers. Masking can be accomplished through reversible attachment of masking agents to primary amines of the MLP.

An MLP delivery polymer can include an MLP reversibly modified by reaction of primary amines on the peptide with asialoglycoprotein receptor (ASGPr) ligand-containing masking agents, wherein the reversible modification can be physiologically labile, as described in WO 2012/083185. In some embodiments, the masking agent comprises a neutral hydrophilic disubstituted alkylmaleic anhydride:

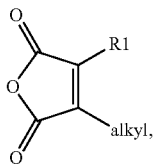

wherein R1 comprises an uncharged asialoglycoprotein receptor ligand. In some embodiments, the alkyl group is a methyl or ethyl group. An example of a substituted alkylmaleic anhydride is a 2-propionic-3-alkylmaleic anhydride derivative. A neutral hydrophilic 2-propionic-3-alkylmaleic anhydride derivative can be formed by attachment of a neutral hydrophilic group to a 2-propionic-3-alkylmaleic anhydride through the 2-propionic-3-alkylmaleic anhydride γ-carboxyl group:

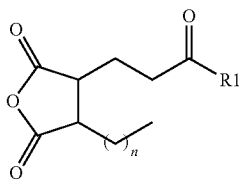

wherein R1 includes a neutral ASGPr ligand and n=0 or 1. In some embodiments, the ASGPr ligand can be linked to the anhydride via a short PEG linker.

The ASGPr ligand provides targeting function through affinity for ASGPr. ASGPr ligands contain saccharides having affinity for the ASGPr, including but not limited to: galactose, N-acetyl-galactosamine and galactose derivatives. Galactose derivatives having affinity for the ASGPr are well known in the art.

In some embodiments, a composition is described that includes:

N-T and MLP-(L-M)$_x$, wherein N is an F12 RNAi trigger, T comprises a hydrophobic group having 20 or more carbon atoms, such as cholesterol, MLP is a melittin-like peptide, and M contains an ASGPr ligand covalently linked to MLP via a physiologically labile reversible maleamate linkage L. x is an integer greater than 1. More specifically, the value of x is greater than 80%, greater than 90%, or greater than 95% of the number of primary amines on a population MLP. As used herein, MLP-(L-M)=can be referred to as an MLP delivery polymer (e.g., an excipient). In some embodiments, an F12 RNAi trigger-cholesterol conjugate and an MLP delivery polymer can be supplied in the same container. In other embodiments, an F12 RNAi trigger-cholesterol conjugate and an MLP delivery polymer can be supplied in separate containers. An F12 RNAi trigger-cholesterol conjugate and an MLP delivery polymer may be combined prior to administration, co-administered, or administered sequentially.

Cells, tissues, and non-human organisms that include at least one of the RNAi triggers described herein is contemplated. The cell, tissue, or non-human organism is made by delivering the RNAi trigger to the cell, tissue, or non-human organism by any means available in the art. In some embodiments, the cell is a mammalian cell, including, but no limited to, a human cell. The cell, tissue, or non-human organisms are useful for research or as research tools (e.g., drug testing or diagnoses).

The above provided embodiments and items are now illustrated with the following, non-limiting examples.

EXAMPLES

Example 1

RNAi Trigger Synthesis

A) Synthesis.

RNAi trigger molecules were synthesized according to phosphoramidite technology on solid phase used in oligonucleotide synthesis. Depending on the scale either a MerMade96E (Bioautomation) or a MerMade12 (Bioautomation) was used. Syntheses were performed on a solid support made of controlled pore glass (CPG, 500 Å or 600 Å, obtained from Prime Synthesis, Aston, Pa., USA). All DNA, 2'-modified RNA, and UNA phosphoramidites were purchased from Thermo Fisher Scientific (Milwaukee, Wis., USA). Specifically, the following 2'-O-Methyl phosphoramidites were used: (5'-O-dimethoxytrityl-N$^6$-(benzoyl)-2'-O-methyl-adenosine-3'-O-(2-cyanoethyl-N,N-diisopropylamino) phosphoramidite, 5'-O-dimethoxy-trityl-N$^4$-

(acetyl)-2'-O-methyl-cytidine-3'-O-(2-cyanoethyl-N,N-diisopropylamino) phosphoramidite, (5'-O-dimethoxytrityl-N²-(isobutyryl)-2'-O-methyl-guanosine-3'-O-(2-cyanoethyl-N,N-diisopropylamino)phosphoramidite, and 5'-O-dimethoxy-trityl-2'-O-methyl-uridine-3'-O-(2-cyanoethyl-N,N-diisopropylamino)phosphoramidite. The 2'-Deoxy-2'-fluoro-phosphor-amidites carried the same protecting groups as the 2'-O-methyl RNA amidites. The following UNA phosphoramidites were used: 5'-(4,4'-Dimethoxytrityl)-N-benzoyl-2',3'-seco-adenosine, 2'-benzoyl-3'-[(2-cyanoethyl)-(N,N-diisopropyl)]-phosphoramidite, 5'-(4,4'-Dimethoxytrityl)-N-acetyl-2',3'-seco-cytosine, 2'-benzoyl-3'-[(2-cyanoethyl)-(N,N-diisopropyl)]-phosphoramidite, 5'-(4,4'-Dimethoxytrityl)-N-isobutyryl-2',3'-seco-guanosine, 2'-benzoyl-3'-[(2-cyanoethyl)-(N,N-diisopropyl)]-phosphoramidite, and 5'-(4,4'-Dimethoxytrityl)-2',3'-seco-uridine, 2'-benzoyl-3'-[(2-cyanoethyl)-(N,N-diisopropyl)]-phosphoramidite. All amidites were dissolved in anhydrous acetonitrile (50 mM) and molecular sieves (3 Å) were added. In order to introduce the TEG-Cholesterol at the 5'-end of the oligomers, the 1-Dimethoxytrityloxy-3-O—(N-cholesteryl-3-aminopropyl)-triethyleneglycol-glyceryl-2-O-(2-cyanoethyl)-(N,N,-diisopropyl)-phosphoramidite from Glen Research (Sterling, Va., USA) was employed. The 5'-modifications were introduced without any modification of the synthesis cycle. 5-Benzylthio-1H-tetrazole (BTT, 250 mM in acetonitrile) was used as activator solution. Coupling times were 10 min (RNA), 180 sec (Cholesterol), 90 sec (2'OMe and UNA), and 60 sec (2'F and DNA). In order to introduce phosphorothioate linkages, a 100 mM solution of 3-phenyl 1,2,4-dithiazoline-5-one (POS, obtained from PolyOrg, Inc., Leominster, Mass., USA) in anhydrous Acetonitrile was employed. See Tables 1-3 for specific sequences.

B. Cleavage and Deprotection of Support Bound Oligomer. After finalization of the solid phase synthesis, the dried solid support was treated with a 1:1 volume solution of 40 wt. % methylamine in water and 28% ammonium hydroxide solution (Aldrich) for two hours at 30° C. The solution was evaporated and the solid residue was reconstituted in water (see below).

C. Purification. Crude Cholesterol containing oligomers were purified by reverse phase HPLC using a Waters XBridge BEH300 C4 5u Prep column and a Shimadzu LC-8 system. Buffer A was 100 mM TEAA, pH 7.5 and contained 5% Acetonitrile and buffer B was 100 mM TEAA and contained 95% Acetonitrile. UV traces at 260 nm were recorded. Appropriate fractions were then run on size exclusion HPLC using a GE Healthcare XK 16/40 column packed with Sephadex G-25 medium with a running buffer of 100 mM ammonium bicarbonate, pH 6.7 and 20% Acetonitrile. Other crude oligomers were purified by anionic exchange HPLC using a TKSgel SuperQ-5PW 13u column and Shimadzu LC-8 system. Buffer A was 20 mM Tris, 5 mM EDTA, pH 9.0 and contained 20% Acetonitrile and buffer B was the same as buffer A with the addition of 1.5 M sodium chloride. UV traces at 260 nm were recorded. Appropriate fractions were pooled then run on size exclusion HPLC as described for cholesterol containing oligomers.

D. Annealing. Complementary strands were mixed by combining equimolar solutions (sense and antisense) in 0.2×PBS (Phosphate-Buffered Saline, 1×, Corning, Cellgro) to form the RNAi triggers. This solution was placed into a thermomixer at 70° C., heated to 95° C., held at 95° C. for 5 min, and cooled to room temperature slowly. Some RNAi triggers were lyophilized and stored at −15 to −25° C. Duplex concentration was determined by measuring the solution absorbance on a UV-Vis spectrometer in 0.2×PBS. The solution absorbance at 260 nm was then multiplied by a conversion factor and the dilution factor to determine the duplex concentration. Unless otherwise stated, all conversion factor was 0.037 mg/(mL·cm). For some experiments, a conversion factor was calculated from an experimentally determined extinction coefficient.

Example 2

Melittin-Like-Peptide (MLP) Delivery Polymer

A) Melittin-Like-Peptide (MLP) Synthesis. All MLPs were made using peptide synthesis techniques standard in the art. Independently of L or D form, the MLP sequence can be reversed (retro).

B) CDM-NAG (N-Acetyl Galactosamine) Synthesis. To a solution of CDM (300 mg, 0.16 mmol) in 50 mL methylene chloride was added oxalyl chloride (2 g, 10 wt. eq.) and dimethylformamide (5 µl). The reaction was allowed to proceed overnight, after which the excess oxalyl chloride and methylene chloride were removed by rotary evaporation to yield the CDM acid chloride. The acid chloride was dissolved in 1 mL of methylene chloride. To this solution was added 1.1 molar equivalents (aminoethoxy)ethoxy-2-(acetylamino)-2-deoxy-3-D-galactopyranoside (i.e. amino bisethoxyl-ethyl NAG) and pyridine (200 µl, 1.5 eq) in 10 mL of methylene chloride. The solution was then stirred 1.5 h. The solvent was then removed and the resulting solid was dissolved into 5 mL of water and purified using reverse-phase HPLC using a 0.1% TFA water/acetonitrile gradient.

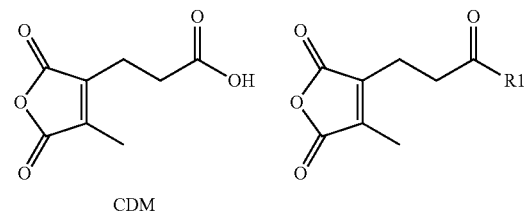

CDM

R1 comprises a neutral ASGPr ligand. In some embodiments, the Masking Agent is uncharged.

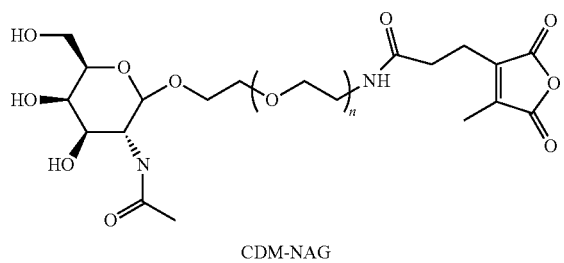

CDM-NAG n is an integer from 1 to 10. As shown above, a PEG spacer may be positioned between the anhydride group and the ASGPr ligand. In some embodiments, a PEG spacer contains 1-10 ethylene units. Alternatively an alkyl spacer may be used between the anhydride and the N-acetyl-galactosamine (NAG).

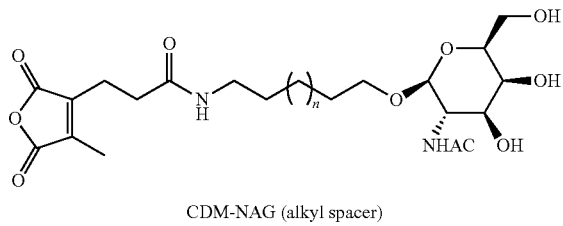

CDM-NAG (alkyl spacer)

n is a integer from 0 to 6.

Other spacers or linkers may be used between the anhydride and the N-acetyl-galactosamine. In some embodiments, the spacer or linker is, a hydrophilic, and neutral or uncharged.

C) Formation of the MLP Delivery Polymer (i.e. Masking). The MLP was reacted with CDM-NAG masking agent to yield the MLP delivery polymer. The MLP component was first dissolved to a final concentration of 8.5 mg/mL in aqueous HEPES (sodium salt, GMP grade, ~430 mg/mL). The MLP solution was then cooled to 4° C., and checked for appearance (clear to pale yellow solution free of visible particulate) and for concentration by UV spectrophotometry. CDM-NAG was dissolved in water at 4° C. at a final concentration of ~75 mg/mL. The solution was checked for appearance (clear to pale yellow solution free of visible particulate) and for concentration by UV spectrophotometry. MLP in solution was mixed with CDM-NAG in solution at a 5:1 (w/w) ratio of CDM-NAG to MLP. The addition rate of CDM-NAG solution was approximately 0.3 L per minute, while stirring. After all CDM-NAG solution had been added to the MLP solution, the mixture was stirred for 30 min. To stabilize the MLP delivery polymer, the pH was increased to 9.0±0.2 by addition of 1 M aqueous sodium hydroxide. Reaction of disubstituted maleic anhydride masking agent with the peptide yielded a compound having the structure represented by:

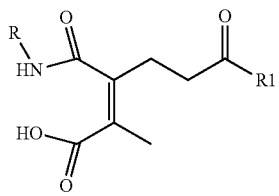

wherein R is MLP and R1 comprises an ASGPr ligand (e.g. NAG).

Colorimetric trinitrobenzene sulfonic acid (TNBS) assay of remaining free amines was used to determine that MLP was sufficiently masked by CDM-NAG, less than 10% of the total number of MLP amines remained unmodified.

MLP delivery polymer was purified by diafiltration against 10 mM, pH 9.2 carbonate buffer to remove excess CDM-NAG. The diafiltration process exchanged ~10 volumes of carbonate buffer per volume of masked MLP reaction solution and held at 2-8° C.

| Component | Quantity (nominal) |
|---|---|
| MLP | 30 g/L |
| CDM-NAG[a] | 25 g/L |
| Sodium carbonate | 0.3 g/L |
| Sodium bicarbonate | 0.6 g/L |
| Water | 1000 g/L |

[a]assumes five (5) CDM-NAG moieties per MLP

The MLP delivery polymer was further formulated with Dextran to 10% w/v and stored at 2 to 8° C. 228 mg MLP delivery polymer, 500 mg 1 kDa dextran, 1.59 mg $Na_2CO_3$, 2.94 mg $NaHCO_3$. For some experiments, this solution was lyophilized prior to use.

D) Injection Solution. The injection solution was formed by mixing RNAi trigger with the MLP delivery polymer. The lyophilized MLP delivery polymer was dissolved in water and mixed with the RNAi trigger. That solution was then diluted to the correct injection concentration with normal saline.

Example 3

In Vitro Screening of F12 RNAi Triggers

A) Human Cell Background. Candidate sequences identified as human, non-human primate and mouse cross-reactive by in silico analysis were screened as chemically modified canonical siRNAs in vitro. Thirty-two of the in silico identified potential F12 RNAi triggers were synthesized as canonical siRNAs and screened for efficacy in vitro. For screening purposes, the human F12 cDNA sequence (accession #NM_000505) was synthesized and cloned (DNA 2.0, Menlo Park, Calif.) into a commercially-available reporter-based screening plasmid, psiCHECK2 (Promega, Madison, Wis.) which generated a Renilla luciferase/F12 fusion mRNA. For siRNA efficacy in the human background, Hep3B cells, a human hepatocellular carcinoma line, were plated at ~10,000 cells per well in 96-well format. Each of the 32 F12 siRNAs was co-transfected at two concentrations, 1 nM and 0.1 nM, with 25 ng F12-psiCHECK2 plasmid DNA per well and 0.2 µL Lipo-Fectamine 2000 per well. Gene knockdown was determined by measuring Renilla luciferase levels normalized to the levels of constitutively-expressed firefly luciferase, also present on the psiCHECK2 plasmid, using the Dual Luciferase Reporter Assay (Promega, Madison, Wis.).

TABLE 6

Efficacy screen results of human/non-human primate/mouse cross-reactive RNAi triggers in human background, as determined by dual-luciferase reporter assay.

| | | | | | Relative Rluc-F12 Expression | |
|---|---|---|---|---|---|---|
| AD Number | Antisense Strand ID | SEQ ID | Sense strand ID | SEQ ID | 1 nM Average ± SD | 0.1 nM Average ± SD |
| AD00459 | AM00978-AS | 451 | AM00913-SS | 837 | 0.871 ± 0.138 | 0.956 ± 0.096 |
| AD00460 | AM00979-AS | 452 | AM00914-SS | 838 | 0.878 ± 0.040 | 1.044 ± 0.127 |
| AD00461 | AM00980-AS | 453 | AM00915-SS | 839 | 0.941 ± 0.163 | 1.003 ± 0.052 |

TABLE 6-continued

Efficacy screen results of human/non-human primate/mouse cross-reactive RNAi triggers in human background, as determined by dual-luciferase reporter assay.

| | | | | | Relative Rluc-F12 Expression | |
|---|---|---|---|---|---|---|
| AD Number | Antisense Strand ID | SEQ ID | Sense strand ID | SEQ ID | 1 nM Average ± SD | 0.1 nM Average ± SD |
| AD00462 | AM00981-AS | 454 | AM00916-SS | 840 | 0.515 ± 0.068 | 0.584 ± 0.117 |
| AD00463 | AM00982-AS | 455 | AM00917-SS | 841 | 0.476 ± 0.014 | 0.552 ± 0.098 |
| AD00464 | AM00983-AS | 456 | AM00918-SS | 842 | 0.302 ± 0.072 | 0.442 ± 0.024 |
| AD00465 | AM00984-AS | 457 | AM00919-SS | 843 | 0.428 ± 0.042 | 0.517 ± 0.037 |
| AD00466 | AM00985-AS | 458 | AM00920-SS | 844 | 0.196 ± 0.016 | 0.282 ± 0.088 |
| AD00467 | AM00986-AS | 459 | AM00921-SS | 845 | 0.200 ± 0.034 | 0.303 ± 0.063 |
| AD00468 | AM00987-AS | 460 | AM00922-SS | 846 | 0.255 ± 0.032 | 0.300 ± 0.042 |
| AD00469 | AM00988-AS | 461 | AM00923-SS | 847 | 0.272 ± 0.060 | 0.411 ± 0.022 |
| AD00470 | AM00989-AS | 462 | AM00924-SS | 848 | 0.205 ± 0.011 | 0.328 ± 0.044 |
| AD00471 | AM00990-AS | 463 | AM00925-SS | 849 | 0.524 ± 0.105 | 0.667 ± 0.040 |
| AD00472 | AM00991-AS | 464 | AM00926-SS | 850 | 0.957 ± 0.062 | 0.909 ± 0.056 |
| AD00473 | AM00992-AS | 465 | AM00927-SS | 851 | 0.390 ± 0.093 | 0.502 ± 0.033 |
| AD00474 | AM00993-AS | 466 | AM00928-SS | 852 | 0.247 ± 0.083 | 0.420 ± 0.045 |
| AD00475 | AM00994-AS | 467 | AM00929-SS | 853 | 1.137 ± 0.029 | 1.049 ± 0.056 |
| AD00476 | AM00995-AS | 468 | AM00930-SS | 854 | 1.062 ± 0.221 | 0.873 ± 0.114 |
| AD00477 | AM00996-AS | 469 | AM00931-SS | 855 | 0.657 ± 0.022 | 0.881 ± 0.107 |
| AD00478 | AM00997-AS | 470 | AM00932-SS | 856 | 0.986 ± 0.118 | 0.856 ± 0.107 |
| AD00479 | AM00998-AS | 471 | AM00933-SS | 857 | 1.048 ± 0.023 | 0.920 ± 0.030 |
| AD00480 | AM00999-AS | 472 | AM00934-SS | 858 | 0.579 ± 0.026 | 0.608 ± 0.123 |
| AD00481 | AM01000-AS | 473 | AM00935-SS | 859 | 0.633 ± 0.081 | 0.779 ± 0.102 |
| AD00482 | AM01001-AS | 474 | AM00936-SS | 860 | 0.639 ± 0.100 | 0.708 ± 0.107 |
| AD00483 | AM01002-AS | 475 | AM00937-SS | 861 | 0.761 ± 0.100 | 0.694 ± 0.102 |
| AD00484 | AM01003-AS | 476 | AM00938-SS | 862 | 1.178 ± 0.074 | 1.168 ± 0.226 |
| AD00485 | AM01004-AS | 477 | AM00939-SS | 863 | 1.261 ± 0.218 | 0.964 ± 0.030 |
| AD00486 | AM01005-AS | 478 | AM00940-SS | 864 | 1.155 ± 0.278 | 1.084 ± 0.073 |
| AD00487 | AM01006-AS | 479 | AM00941-SS | 865 | 1.216 ± 0.081 | 1.161 ± 0.044 |
| AD00488 | AM01007-AS | 480 | AM00942-SS | 866 | 1.058 ± 0.051 | 1.112 ± 0.107 |
| AD00489 | AM01008-AS | 481 | AM00943-SS | 867 | 1.152 ± 0.189 | 0.980 ± 0.077 |
| AD00490 | AM01009-AS | 482 | AM00944-SS | 868 | 1.103 ± 0.273 | 1.138 ± 0.052 |

B) Mouse Primary Cell Background. The same 32 siRNAs were screened for efficacy in a mouse background. Mouse primary hepatocytes were obtained cryopreserved or pre-plated in 96-well plates (TRL Research, Research Triangle Park, N.C.). SiRNAs were transfected at two concentrations, 1 nM and 0.1 nM, for 4 h with 0.6 μL per well of Lipofectamine RNAiMax (Life Technologies, Grand Island, N.Y.), after which fresh medium was supplied. After 24 h cells were lysed for gene expression analysis using the TaqMan Gene Expression Cells-to-CT Kit (Life Technologies). Using mouse-specific TaqMan gene expression assays (Life Technologies), F12 expression relative to the endogenous control, β-actin, was determined by qRT-PCR.

TABLE 7

Efficacy screen results of human/non-human primate/mouse cross-reactive RNAi triggers in mouse background, as determined by qRT-PCR and comparative $C_T$ analysis.

| | Relative Mouse F12 Expression | | | | | |
|---|---|---|---|---|---|---|
| | 1.0 nM | | | 0.1 nM | | |
| | | error | | | error | |
| AD Number | Average | low | high | Average | low | high |
| AD00459 | 0.367 | 0.019 | 0.020 | 0.468 | 0.091 | 0.113 |
| AD00460 | 0.494 | 0.080 | 0.096 | 0.710 | 0.079 | 0.089 |
| AD00461 | 0.353 | 0.053 | 0.063 | 0.673 | 0.090 | 0.104 |
| AD00462 | 0.320 | 0.072 | 0.093 | 0.553 | 0.034 | 0.037 |
| AD00463 | 0.377 | 0.016 | 0.017 | 0.706 | 0.066 | 0.073 |
| AD00464 | 0.232 | 0.044 | 0.055 | 0.418 | 0.087 | 0.110 |
| AD00465 | 0.335 | 0.033 | 0.037 | 0.691 | 0.092 | 0.106 |
| AD00466 | 0.271 | 0.018 | 0.019 | 0.406 | 0.067 | 0.080 |
| AD00467 | 0.070 | 0.014 | 0.018 | 0.204 | 0.008 | 0.009 |
| AD00468 | 0.156 | 0.031 | 0.039 | 0.259 | 0.038 | 0.044 |
| AD00469 | 0.157 | 0.020 | 0.024 | 0.335 | 0.028 | 0.031 |
| AD00470 | 0.228 | 0.030 | 0.035 | 0.320 | 0.042 | 0.048 |
| AD00471 | 0.347 | 0.031 | 0.035 | 0.376 | 0.082 | 0.106 |
| AD00472 | 0.496 | 0.043 | 0.048 | 0.579 | 0.129 | 0.166 |
| AD00473 | 0.257 | 0.019 | 0.020 | 0.518 | 0.107 | 0.136 |
| AD00474 | 0.223 | 0.021 | 0.023 | 0.228 | 0.033 | 0.038 |
| AD00475 | 1.024 | 0.177 | 0.214 | 0.909 | 0.069 | 0.075 |
| AD00476 | 1.110 | 0.029 | 0.030 | 1.160 | 0.118 | 0.132 |
| AD00477 | 0.713 | 0.034 | 0.036 | 0.934 | 0.042 | 0.044 |
| AD00478 | 1.187 | 0.075 | 0.080 | 1.114 | 0.086 | 0.093 |
| AD00479 | 1.168 | 0.117 | 0.130 | 0.889 | 0.076 | 0.083 |
| AD00480 | 0.380 | 0.078 | 0.098 | 0.489 | 0.049 | 0.055 |
| AD00481 | 0.528 | 0.115 | 0.147 | 0.607 | 0.105 | 0.128 |
| AD00482 | 0.359 | 0.050 | 0.058 | 0.367 | 0.065 | 0.079 |
| AD00483 | 0.307 | 0.021 | 0.022 | 0.493 | 0.105 | 0.133 |
| AD00484 | 0.980 | 0.032 | 0.033 | 0.640 | 0.167 | 0.226 |
| AD00485 | 0.218 | 0.026 | 0.029 | 0.179 | 0.033 | 0.040 |
| AD00486 | 0.208 | 0.006 | 0.006 | 0.173 | 0.019 | 0.021 |
| AD00487 | 0.233 | 0.018 | 0.019 | 0.185 | 0.018 | 0.020 |
| AD00488 | 0.223 | 0.030 | 0.035 | 0.267 | 0.031 | 0.035 |
| AD00489 | 0.169 | 0.023 | 0.027 | 0.180 | 0.014 | 0.015 |
| AD00490 | 0.271 | 0.058 | 0.075 | 0.139 | 0.016 | 0.018 |

C) $EC_{50}$ Calculation. Six candidate RNAi triggers were further assessed. Ten-point $EC_{50}$ curves were generated using the same cells and transfection conditions, as in A) above, with siRNA concentrations ranging from 150 fM to 3 nM. Each of these six F12 RNAi triggers was further modified and synthesized as a corresponding UNA-containing RNAi trigger. All modified RNAi triggers were examined by in vitro knockdown analysis by both 3-concentration analysis (0.02, 0.2 and 2 nM) and ten-point $EC_{50}$ determination.

TABLE 8

$EC_{50}$ values (nM) determined in the human background for the indicated RNAi triggers.

| Duplex ID No. | | | | | $EC_{50}$ (nM) |
|---|---|---|---|---|---|
| AD00466 | | | | | 0.019 |
| AD00903 | AM01622-AS | 597 | AM00920-SS | 844 | 0.049 |
| AD00904 | AM01623-AS | 598 | AM00920-SS | 844 | 0.057 |
| AD00915 | AM01621-AS | 596 | AM01614-SS | 983 | 0.049 |
| AD00916 | AM00985-AS | 458 | AM01614-SS | 983 | 0.189 |
| AD00467 | | | | | 0.133 |
| AD00905 | AM01624-AS | 599 | AM00921-SS | 845 | 0.076 |
| AD00906 | AM01625-AS | 600 | AM00921-SS | 845 | 0.104 |
| AD00468 | | | | | 0.081 |
| AD00907 | AM01626-AS | 601 | AM00922-SS | 846 | 0.143 |
| AD00908 | AM01627-AS | 602 | AM00922-SS | 846 | 0.077 |
| AD00469 | | | | | 0.070 |
| AD00909 | AM01629-AS | 604 | AM00923-SS | 847 | 0.049 |
| AD00910 | AM01630-AS | 605 | AM00923-SS | 847 | 0.037 |
| AD00917 | AM01628-AS | 603 | AM01618-SS | 987 | 0.089 |
| AD00918 | AM00988-AS | 461 | AM01618-SS | 987 | 0.103 |
| AD00470 | | | | | 0.145 |
| AD00911 | AM01631-AS | 606 | AM00924-SS | 848 | 0.982 |
| AD00912 | AM01632-AS | 607 | AM00924-SS | 848 | 0.153 |
| AD00474 | | | | | 0.261 |
| AD00913 | AM01633-AS | 608 | AM00928-SS | 852 | 0.132 |
| AD00914 | AM01634-AS | 609 | AM00928-SS | 852 | 0.175 |

D) Human/Non-Human Primate-Specific RNAi Triggers. Additional sequences identified as human and non-human primate, but not mouse, cross-reactive by in silico analysis were additionally screened in human background. The top twelve sequences were screened using the procedure described above, with full 10-point dose response curves and $EC_{50}$ determination performed for the six most active RNAi triggers.

TABLE 9

Efficacy screen of human/non-human primate-specific RNAi triggers and $EC_{50}$ values (nM).

| | Relative $R_{luc}$-F12 Expression | | |
|---|---|---|---|
| SEQ ID pair | 1 nM Average ± SD | 0.1 nM Average ± SD | $EC_{50}$ (nM) |
| 1940/2053 | 0.172 ± 0.018 | 0.314 ± 0.007 | 0.026 |
| 1941/2054 | 0.218 ± 0.021 | 0.312 ± 0.029 | 0.013 |
| 1943/2056 | 0.139 ± 0.016 | 0.245 ± 0.060 | 0.027 |
| 1944/2054 | 0.258 ± 0.007 | 0.314 ± 0.037 | |
| 1946/2059 | 0.166 ± 0.016 | 0.225 ± 0.022 | 0.017 |
| 1947/2060 | 0.273 ± 0.029 | 0.382 ± 0.071 | |
| 1951/2064 | 0.536 ± 0.011 | 1.108 ± 0.210 | |
| 1966/2079 | 0.745 ± 0.080 | 0.963 ± 0.051 | |
| 1971/2084 | 0.714 ± 0.018 | 0.853 ± 0.088 | |
| 1982/2095 | 0.519 ± 0.065 | 0.680 ± 0.081 | |
| 1983/2096 | 0.454 ± 0.003 | 0.622 ± 0.071 | |
| 2013/2126 | 0.579 ± 0.006 | 0.778 ± 0.108 | |

Example 4

In Vivo Analysis of RNAi Trigger Efficacy in Wild-Type Mice or Rates

A) Administration and Sample Collection. In order to evaluate the efficacy of F12 RNAi triggers in vivo, wild-type mice or rats were used. RNAi triggers were dosed either by intravenous (IV) or subcutaneous (SQ) injection. Cholesterol-targeted RNAi triggers were administered to mice or rats using MLP delivery polymer on day 1. Each rodent received an intravenous (IV) injection into the tail vein of 200-250 μL solution containing a dose of RNAi trigger+ MLP delivery polymer (1:1 w/w RNAi trigger: MLP delivery polymer in most cases). Alkyne-containing RNAi triggers were administered to mice after conjugation with targeting polymer by either IV or SQ injection. Galactose-cluster containing RNAi triggers were most often dosed SQ, but could also be dosed in combination with MLP delivery polymer. When possible, baseline (pre-treatment) samples were taken from the mice pre-injection between days 7 and injection on day 1. Post injection serum samples were taken from the mice days 4, 8, and weekly up to day 71. In some mice, liver tissue was harvested for RNA isolation on days indicated.

B) Factor 12 Serum Protein Levels. F12 protein (mF12) levels in serum were monitored by assaying serum from the mice using an ELISA for mF12 (Molecular Innovations) or an internally developed mF12 alphaLISA® (Perkin Elmer) until expression levels returned to baseline. For animals with baseline samples, mF12 level for each animal at a respective time point was divided by the pre-treatment level of expression in that animal to determine the ratio of expression "normalized to pre-treatment". Expression at a specific time point was then normalized to the saline control group by dividing the "normalized to day pre-treatment" ratio for an individual animal by the mean "normalized to day pre-treatment" ratio of all mice in the saline control group. This resulted in expression for each time point normalized to that in the control group. For samples without baseline samples, expression at a specific bleed date was normalized to the mean of the saline control group for that same date. For all studies, experimental error is given as standard deviation.

Example 5

In Vivo Screening F12 RNAi Triggers and Time Course of F12 Knockdown

Wild-type mice were dosed either IV (cholesterol-conjugated RNAi trigger with delivery polymer) or subcutaneous (SQ) (galactose-cluster-conjugated RNAi trigger), and mF12 levels were monitored as described above. Maximum knockdown (nadir) of mF12 for each RNAi trigger examined is shown in Table 10. Nadir was between days 4-22. Relative serum mF12 levels following administration of RNAi triggers over the time of the experiment is shown for select RNAi triggers tested (see Tables 11, 12, 13, 14, 15 and 16, FIG. 1). A decrease in F12 serum protein level of greater than 98% was obtained following administration of all RNAi triggers tested, with AD00900 showing greatest duration of knockdown (>87% knockdown at day 36). RD10694, a known mouse Factor VII (mF7) RNAi trigger sequence, was used as a control RNAi trigger in these experiments (Table 10).

TABLE 10

Relative serum F12 protein levels in mice following intravenous administration of the indicated F12 RNAi trigger with MLP (delivery polymer) or subcutaneous administration of the indicated F12 RNAi trigger (no delivery polymer). mF12 levels were normalized to pre-treatment and saline control. (F12 RNAi trigger Duplex ID No. with sense strand and antisense strand ID Nos.)

| Duplex ID No. | Antisense Strand ID | SEQ ID | Sense Strand ID | SEQ ID | RNAi trigger (mg/kg) | Delivery Polymer (mg/kg) | Relative Factor 12 |
|---|---|---|---|---|---|---|---|
| AD00897 | AM00985-AS | 458 | AM01613-SS | 982 | 8 | 8 | 0.007 |
| AD00898 | AM00986-AS | 459 | AM01615-SS | 984 | 8 | 8 | 0.007 |
| AD00899 | AM00987-AS | 460 | AM01616-SS | 985 | 8 | 8 | 0.009 |
| AD00900 | AM00988-AS | 461 | AM01617-SS | 986 | 8 | 8 | 0.007 |
| AD00901 | AM00989-AS | 462 | AM01619-SS | 988 | 8 | 8 | 0.020 |
| AD00902 | AM00993-AS | 466 | AM01620-SS | 989 | 8 | 8 | 0.012 |
| AD00998 | AM01622-AS | 597 | AM01613-SS | 982 | 2 | 2 | 0.284 |
| AD00999 | AM01624-AS | 599 | AM01615-SS | 984 | 2 | 2 | 0.175 |
| AD01000 | AM01626-AS | 601 | AM01616-SS | 985 | 2 | 2 | 0.052 |
| AD01001 | AM01629-AS | 604 | AM01617-SS | 986 | 2 | 2 | 0.048 |
| AD01002 | AM01631-AS | 606 | AM01619-SS | 988 | 2 | 2 | 0.253 |
| AD01003 | AM01633-AS | 608 | AM01620-SS | 989 | 2 | 2 | 0.132 |
| AD01004 | AM01623-AS | 598 | AM01613-SS | 982 | 2 | 2 | 0.136 |
| AD01005 | AM01625-AS | 600 | AM01615-SS | 984 | 2 | 2 | 0.464 |
| AD01006 | AM01627-AS | 602 | AM01616-SS | 985 | 2 | 2 | 0.268 |
| AD01007 | AM01630-AS | 605 | AM01617-SS | 986 | 2 | 2 | 0.127 |
| AD01008 | AM01632-AS | 607 | AM01619-SS | 988 | 2 | 2 | 0.263 |
| AD01009 | AM01634-AS | 609 | AM01620-SS | 989 | 2 | 2 | 0.228 |
| AD01109 | AM01903-AS | 610 | AM01616-SS | 985 | 0.5 | 2 | 0.243 |
| AD01110 | AM01904-AS | 611 | AM01905-SS | 990 | 0.5 | 2 | 0.263 |
| AD01111 | AM01906-AS | 612 | AM01617-SS | 986 | 0.5 | 2 | 0.159 |
| AD01112 | AM01907-AS | 613 | AM01908-SS | 991 | 0.5 | 2 | 0.293 |
| AD01113 | AM01909-AS | 614 | AM01620-SS | 989 | 0.5 | 2 | 0.289 |
| AD01114 | AM01910-AS | 615 | AM01911-SS | 992 | 0.5 | 2 | 0.645 |
| AD01115 | AM01918-AS | 619 | AM01905-SS | 990 | 0.5 | 2 | 0.202 |
| AD01116 | AM01919-AS | 620 | AM01908-SS | 991 | 0.5 | 2 | 0.204 |
| AD01117 | AM01920-AS | 621 | AM01911-SS | 992 | 0.5 | 2 | 0.266 |
| AD01118 | AM01927-AS | 625 | AM01924-SS | 994 | 0.5 | 2 | 0.275 |
| AD01119 | AM01928-AS | 626 | AM01924-SS | 994 | 0.5 | 2 | 0.442 |
| AD01120 | AM01929-AS | 627 | AM01924-SS | 994 | 0.5 | 2 | 0.374 |
| AD01121 | AM01931-AS | 629 | AM01932-SS | 996 | 0.5 | 2 | 0.284 |
| AD01122 | AM01915-AS | 616 | AM01617-SS | 986 | 0.5 | 2 | 0.144 |
| AD01123 | AM01916-AS | 617 | AM01908-SS | 991 | 0.5 | 2 | 0.226 |
| AD01124 | AM01917-AS | 618 | AM01908-SS | 991 | 0.5 | 2 | 0.158 |
| AD01125 | AM01921-AS | 622 | AM01922-SS | 993 | 0.5 | 2 | 0.271 |
| AD01126 | AM01923-AS | 623 | AM01924-SS | 994 | 0.5 | 2 | 0.247 |
| AD01127 | AM01925-AS | 624 | AM01926-SS | 995 | 0.5 | 2 | 0.526 |
| AD01128 | AM01930-AS | 628 | AM01932-SS | 996 | 0.5 | 2 | 0.332 |
| AD01181 | AM01996-AS | 630 | AM01995-SS | 997 | 0.5 | 2 | 0.100 |
| AD01182 | AM01997-AS | 631 | AM01995-SS | 997 | 0.5 | 2 | 0.167 |
| AD01251 | AM01629-AS | 604 | AM02084-SS | 1000 | 0.5 | 4 | 0.724 |
| AD01303 | AM02165-AS | 637 | AM02168-SS | 1002 | 2 | 2 | 0.233 |
| AD01307 | AM02165-AS | 637 | AM02169-SS | 1003 | 2 | 2 | 0.096 |
| AD01312 | AM02171-AS | 640 | AM02173-SS | 1004 | 2 | 2 | 0.194 |
| AD01313 | AM02172-AS | 641 | AM02174-SS | 1005 | 2 | 2 | 0.173 |
| AD01327 | AM02165-AS | 637 | AM02196-SS | 1006 | 2 | 2 | 0.083 |
| AD01367 | AM02197-AS | 642 | AM02269-SS | 1014 | 0.5 | 2 | 0.378 |
| AD01368 | AM02198-AS | 643 | AM02270-SS | 1015 | 0.5 | 2 | 0.516 |
| AD01369 | AM02199-AS | 644 | AM02271-SS | 1016 | 0.5 | 2 | 0.279 |
| AD01370 | AM02172-AS | 641 | AM02272-SS | 1017 | 0.5 | 2 | 0.366 |
| AD01371 | AM02200-AS | 645 | AM02273-SS | 1018 | 0.5 | 2 | 0.476 |
| AD01372 | AM02201-AS | 646 | AM02274-SS | 1019 | 0.5 | 2 | 0.162 |
| AD01373 | AM02208-AS | 647 | AM02275-SS | 1020 | 0.5 | 2 | 0.187 |
| AD01394 | AM02331-AS | 648 | AM02330-SS | 1023 | 2 | 2 | 0.086 |
| AD01395 | AM02332-AS | 649 | AM02330-SS | 1023 | 2 | 2 | 0.089 |
| AD01396 | AM02333-AS | 650 | AM02330-SS | 1023 | 2 | 2 | 0.409 |
| AD01397 | AM02334-AS | 651 | AM02330-SS | 1023 | 2 | 2 | 0.574 |
| AD01398 | AM02335-AS | 652 | AM02330-SS | 1023 | 2 | 2 | 0.063 |
| AD01399 | AM02336-AS | 653 | AM02330-SS | 1023 | 2 | 2 | 0.765 |
| AD01400 | AM02337-AS | 654 | AM02330-SS | 1023 | 2 | 2 | 0.179 |
| AD01401 | AM02338-AS | 655 | AM02330-SS | 1023 | 2 | 2 | 0.083 |
| AD01402 | AM02339-AS | 656 | AM02330-SS | 1023 | 2 | 2 | 0.348 |
| AD01403 | AM02340-AS | 657 | AM02330-SS | 1023 | 2 | 2 | 0.358 |
| AD01412 | AM02348-AS | 658 | AM02330-SS | 1023 | 2 | 2 | 0.145 |
| AD01413 | AM02349-AS | 659 | AM02351-SS | 1024 | 2 | 2 | 0.223 |
| AD01414 | AM02350-AS | 660 | AM02352-SS | 1025 | 2 | 2 | 0.632 |
| AD01415 | AM02354-As | 661 | AM02353-SS | 1026 | 2 | 2 | 0.696 |
| AD01416 | AM02348-AS | 658 | AM02355-SS | 1027 | 2 | 2 | 0.112 |
| AD01417 | AM02348-AS | 658 | AM02356-SS | 1028 | 2 | 2 | 0.164 |
| AD01418 | AM02348-AS | 658 | AM02357-SS | 1029 | 2 | 2 | 0.723 |

TABLE 10-continued

Relative serum F12 protein levels in mice following intravenous administration of the indicated F12 RNAi trigger with MLP (delivery polymer) or subcutaneous administration of the indicated F12 RNAi trigger (no delivery polymer). mF12 levels were normalized to pre-treatment and saline control. (F12 RNAi trigger Duplex ID No. with sense strand and antisense strand ID Nos.)

| Duplex ID No. | Antisense Strand ID | SEQ ID | Sense Strand ID | SEQ ID | RNAi trigger (mg/kg) | Delivery Polymer (mg/kg) | Relative Factor 12 |
|---|---|---|---|---|---|---|---|
| AD01419 | AM02348-AS | 658 | AM02358-SS | 1030 | 2 | 2 | 0.663 |
| AD01420 | AM02348-AS | 658 | AM02359-SS | 1031 | 2 | 2 | 0.066 |
| AD01421 | AM02348-AS | 658 | AM02360-SS | 1032 | 2 | 2 | 0.145 |
| AD01422 | AM02348-AS | 658 | AM02361-SS | 1033 | 2 | 2 | 0.107 |
| AD01423 | AM02348-AS | 658 | AM02362-SS | 1034 | 2 | 2 | 0.081 |
| AD01443 | AM02395-AS | 662 | AM02399-SS | 1035 | 2 | 2 | 0.161 |
| AD01444 | AM02396-AS | 663 | AM02400-SS | 1036 | 2 | 2 | 0.415 |
| AD01445 | AM02397-AS | 664 | AM02401-SS | 1037 | 2 | 2 | 0.595 |
| AD01446 | AM02398-AS | 665 | AM02402-SS | 1038 | 2 | 2 | 0.599 |
| AD01453 | AM02432-AS | 666 | AM02431-SS | 1040 | 2 | 2 | 0.258 |
| AD01454 | AM02348-AS | 658 | AM02431-SS | 1040 | 2 | 2 | 0.094 |
| AD01455 | AM02433-AS | 667 | AM02431-SS | 1040 | 2 | 2 | 0.268 |
| AD01456 | AM02434-AS | 668 | AM02435-SS | 1041 | 2 | 2 | 0.181 |
| AD01457 | AM02395-AS | 662 | AM02436-SS | 1042 | 2 | 2 | 0.088 |
| AD01458 | AM02437-AS | 669 | AM02436-SS | 1042 | 2 | 2 | 0.244 |
| AD01459 | AM02438-AS | 670 | AM02436-SS | 1042 | 2 | 2 | 0.197 |
| AD01460 | AM02439-AS | 671 | AM02440-SS | 1043 | 2 | 2 | 0.301 |
| AD01478 | AM02201-AS | 646 | AM02457-SS | 1044 | 10 | 10 | 0.566 |
| AD01479 | AM02208-AS | 647 | AM02458-SS | 1045 | 10 | 10 | 0.654 |
| AD01484 | AM02338-AS | 655 | AM02359-SS | 1031 | 2 | 2 | 0.408 |
| AD01485 | AM02338-AS | 655 | AM02360-SS | 1032 | 2 | 2 | 0.254 |
| AD01486 | AM02338-AS | 655 | AM02361-SS | 1033 | 2 | 2 | 0.215 |
| AD01487 | AM02338-AS | 655 | AM02362-SS | 1034 | 2 | 2 | 0.092 |
| AD01488 | AM02335-AS | 652 | AM02359-SS | 1031 | 2 | 2 | 0.259 |
| AD01489 | AM02335-AS | 652 | AM02360-SS | 1032 | 2 | 2 | 0.101 |
| AD01490 | AM02335-AS | 652 | AM02361-SS | 1033 | 2 | 2 | 0.095 |
| AD01491 | AM02335-AS | 652 | AM02362-SS | 1034 | 2 | 2 | 0.525 |
| AD01498 | AM02349-AS | 659 | AM02490-SS | 1056 | 2 | 2 | 0.197 |
| AD01499 | AM02349-AS | 659 | AM02491-SS | 1057 | 2 | 2 | 0.213 |
| AD01500 | AM02487-AS | 684 | AM02490-SS | 1056 | 2 | 2 | 0.077 |
| AD01501 | AM02487-AS | 684 | AM02491-SS | 1057 | 2 | 2 | 0.185 |
| AD01502 | AM02488-AS | 685 | AM02490-SS | 1056 | 2 | 2 | 0.165 |
| AD01503 | AM02488-AS | 685 | AM02491-SS | 1057 | 2 | 2 | 0.140 |
| AD01504 | AM02165-AS | 637 | AM02494-SS | 1058 | 2 | 2 | 0.071 |
| AD01505 | AM02165-AS | 637 | AM02495-SS | 1059 | 2 | 2 | 0.144 |
| AD01506 | AM02492-AS | 686 | AM02494-SS | 1058 | 2 | 2 | 0.040 |
| AD01507 | AM02492-AS | 686 | AM02495-SS | 1059 | 2 | 2 | 0.222 |
| AD01508 | AM02493-AS | 687 | AM02494-SS | 1058 | 2 | 2 | 0.074 |
| AD01509 | AM02493-AS | 687 | AM02495-SS | 1059 | 2 | 2 | 0.132 |
| AD01510 | AM02502-AS | 688 | AM02496-SS | 1060 | 2 | 2 | 0.863 |
| AD01511 | AM02502-AS | 688 | AM02497-SS | 1061 | 2 | 2 | 0.792 |
| AD01512 | AM02503-AS | 689 | AM02496-SS | 1060 | 2 | 2 | 0.827 |
| AD01513 | AM02503-AS | 689 | AM02497-SS | 1061 | 2 | 2 | 0.784 |
| AD01514 | AM02504-AS | 690 | AM02498-SS | 1062 | 2 | 2 | 0.462 |
| AD01515 | AM02504-AS | 690 | AM02499-SS | 1063 | 2 | 2 | 0.386 |
| AD01516 | AM02505-AS | 691 | AM02498-SS | 1062 | 2 | 2 | 0.430 |
| AD01517 | AM02505-AS | 691 | AM02499-SS | 1063 | 2 | 2 | 0.572 |
| AD01518 | AM02506-AS | 692 | AM02500-SS | 1064 | 2 | 2 | 0.059 |
| AD01519 | AM02506-AS | 692 | AM02501-SS | 1065 | 2 | 2 | 0.163 |
| AD01520 | AM02507-AS | 693 | AM02500-SS | 1064 | 2 | 2 | 0.012 |
| AD01521 | AM02507-AS | 693 | AM02501-SS | 1065 | 2 | 2 | 0.028 |
| AD01535 | AM02543-AS | 694 | AM02545-SS | 1076 | 2 | 2 | 0.190 |
| AD01536 | AM02544-AS | 695 | AM02545-SS | 1076 | 2 | 2 | 0.065 |
| AD01537 | AM02464-AS | 675 | AM02513-SS | 1066 | 10 | 10 | 0.588 |
| AD01538 | AM02466-AS | 676 | AM02514-SS | 1067 | 10 | 10 | 0.705 |
| AD01539 | AM02468-AS | 677 | AM02515-SS | 1068 | 10 | 10 | 0.788 |
| AD01540 | AM02470-AS | 678 | AM02516-SS | 1069 | 10 | 10 | 0.661 |
| AD01541 | AM02472-AS | 679 | AM02517-SS | 1070 | 10 | 10 | 0.577 |
| AD01542 | AM02474-AS | 680 | AM02518-SS | 1071 | 10 | 10 | 0.470 |
| AD01543 | AM02476-AS | 681 | AM02519-SS | 1072 | 10 | 10 | 0.774 |
| AD01544 | AM02478-AS | 682 | AM02520-SS | 1073 | 10 | 10 | 0.647 |
| AD01545 | AM02480-AS | 683 | AM02521-SS | 1074 | 10 | 10 | 0.820 |
| AD01556 | AM02543-AS | 694 | AM02554-SS | 1079 | 2 | 2 | 0.174 |
| AD01557 | AM02544-AS | 695 | AM02554-SS | 1079 | 2 | 2 | 0.440 |
| AD01558 | AM02543-AS | 694 | AM02555-SS | 1080 | 2 | 2 | 0.436 |
| AD01559 | AM02544-AS | 695 | AM02555-SS | 1080 | 2 | 2 | 0.090 |
| AD01560 | AM02543-AS | 694 | AM02556-SS | 1081 | 2 | 2 | 0.274 |
| AD01561 | AM02544-AS | 695 | AM02556-SS | 1081 | 2 | 2 | 0.209 |
| AD01577 | AM02631-AS | 699 | AM02634-SS | 1086 | 2 | 2 | 0.790 |
| AD01578 | AM02631-AS | 699 | AM02637-SS | 1089 | 2 | 2 | 0.688 |

TABLE 10-continued

Relative serum F12 protein levels in mice following intravenous administration of the indicated F12 RNAi trigger with MLP (delivery polymer) or subcutaneous administration of the indicated F12 RNAi trigger (no delivery polymer). mF12 levels were normalized to pre-treatment and saline control. (F12 RNAi trigger Duplex ID No. with sense strand and antisense strand ID Nos.)

| Duplex ID No. | Antisense Strand ID | SEQ ID | Sense Strand ID | SEQ ID | RNAi trigger (mg/kg) | Delivery Polymer (mg/kg) | Relative Factor 12 |
|---|---|---|---|---|---|---|---|
| AD01579 | AM02632-AS | 700 | AM02635-SS | 1087 | 2 | 2 | 0.538 |
| AD01580 | AM02632-AS | 700 | AM02638-SS | 1090 | 2 | 2 | 0.663 |
| AD01581 | AM02633-AS | 701 | AM02636-SS | 1088 | 2 | 2 | 0.575 |
| AD01582 | AM02633-AS | 701 | AM02639-SS | 1091 | 2 | 2 | 0.697 |
| AD01583 | AM02640-AS | 702 | AM02490-SS | 1056 | 2 | 2 | 0.126 |
| AD01598 | AM02199-AS | 644 | AM02581-SS | 1083 | 10 | 10 | 0.579 |
| AD01599 | AM02579-AS | 696 | AM02271-SS | 1016 | 10 | 10 | 1.150 |
| AD01600 | AM02200-AS | 645 | AM02584-SS | 1085 | 10 | 10 | 0.825 |
| AD01601 | AM02582-AS | 697 | AM02273-SS | 1018 | 10 | 10 | 0.838 |
| AD01602 | AM02650-AS | 711 | AM02652-SS | 1094 | 10 | 10 | 0.422 |
| AD01603 | AM02172-AS | 641 | AM02652-SS | 1094 | 10 | 10 | 0.567 |
| AD01604 | AM02650-AS | 711 | AM02272-SS | 1017 | 10 | 10 | 0.456 |
| AD01968 | AM02656-AS | 712 | AM03117-SS | 1176 | 10 | 2.5 | 0.223 |
| AD01969 | AM02656-AS | 712 | AM03118-SS | 1177 | 10 | 2.5 | 0.404 |
| AD02066 | AM02656-AS | 712 | AM03181-SS | 1198 | 5 | 5 | 0.021 |
| AD02067 | AM02656-AS | 712 | AM03182-SS | 1199 | 5 | 5 | 0.030 |
| AD02068 | AM02656-AS | 712 | AM03183-SS | 1200 | 5 | 5 | 0.038 |
| AD02639 | AM03157-AS | 791 | AM03398-SS | 1228 | 2 | 2 | 0.090 |
| AD02640 | AM03157-AS | 791 | AM03399-SS | 1229 | 2 | 2 | 0.165 |
| AD02661 | AM03410-AS | 820 | AM03423-SS | 1247 | 1 | 1 | 0.582 |
| AD02668 | AM03157-AS | 791 | AM03432-SS | 1252 | 1 | 1 | 0.249 |
| AD02669 | AM03157-AS | 791 | AM03438-SS | 1258 | 1 | 1 | 0.239 |
| AD02670 | AM03157-AS | 791 | AM03434-SS | 1254 | 1 | 1 | 0.190 |
| AD02671 | AM03157-AS | 791 | AM03439-SS | 1259 | 1 | 1 | 0.246 |
| AD02672 | AM03157-AS | 791 | AM03436-SS | 1256 | 1 | 1 | 0.305 |
| AD02673 | AM03410-AS | 820 | AM03440-SS | 1260 | 1 | 1 | 0.873 |
| AD02765 | AM03157-AS | 791 | AM03571-SS | 1276 | 0.4 | 4 | 0.010 |
| AD02766 | AM03157-AS | 791 | AM03573-SS | 1278 | 0.4 | 4 | 0.013 |
| AD02767 | AM03157-AS | 791 | AM03575-SS | 1280 | 0.4 | 4 | 0.014 |
| AD02768 | AM03580-AS | 829 | AM03577-SS | 1282 | 0.4 | 4 | 0.011 |
| AD02769 | AM03157-AS | 791 | AM03579-SS | 1284 | 0.4 | 4 | 0.014 |
| AD02770 | AM03581-AS | 830 | AM03579-SS | 1284 | 0.4 | 4 | 0.018 |
| AD02771 | AM03584-AS | 831 | AM02500-SS | 1064 | 2 | 2 | 0.285 |
| AD02772 | AM02507-AS | 693 | AM03586-SS | 1287 | 2 | 2 | 0.700 |
| AD02773 | AM03585-AS | 832 | AM03587-SS | 1288 | 2 | 2 | 0.546 |
| AD01393 | AM02208-AS | 647 | AM02328-SS | 1021 | 10 | | 0.671 |
| AD01447 | AM02208-AS | 647 | AM02403-SS | 1039 | 20 | | 0.706 |
| AD01550 | AM02172-AS | 641 | AM02550-SS | 1077 | 10 | | 0.607 |
| AD01605 | AM02208-AS | 647 | AM02653-SS | 1095 | 10 | | 0.689 |
| AD01607 | AM02474-AS | 680 | AM02655-SS | 1097 | 10 | | 0.794 |
| AD01608 | AM02656-AS | 712 | AM02653-SS | 1095 | 10 | | 0.356 |
| AD01610 | AM02657-AS | 713 | AM02655-SS | 1097 | 10 | | 0.637 |
| AD01611 | AM02658-AS | 714 | AM02655-SS | 1097 | 10 | | 0.857 |
| AD01612 | AM02659-AS | 715 | AM02655-SS | 1097 | 10 | | 0.786 |
| AD01613 | AM02660-AS | 716 | AM02655-SS | 1097 | 10 | | 0.843 |
| AD01614 | AM02661-AS | 717 | AM02655-SS | 1097 | 10 | | 0.841 |
| AD01615 | AM02662-AS | 718 | AM02655-SS | 1097 | 10 | | 1.007 |
| AD01616 | AM02474-AS | 680 | AM02663-SS | 1098 | 10 | | 1.149 |
| AD01617 | AM02658-AS | 714 | AM02663-SS | 1098 | 10 | | 0.845 |
| AD01618 | AM02659-AS | 715 | AM02663-SS | 1098 | 10 | | 1.060 |
| AD01619 | AM02660-AS | 716 | AM02663-SS | 1098 | 10 | | 1.056 |
| AD01620 | AM02661-AS | 717 | AM02663-SS | 1098 | 10 | | 0.978 |
| AD01621 | AM02662-AS | 718 | AM02663-SS | 1098 | 10 | | 1.174 |
| AD01622 | AM02474-AS | 680 | AM02664-SS | 1099 | 10 | | 0.980 |
| AD01623 | AM02658-AS | 714 | AM02664-SS | 1099 | 10 | | 0.909 |
| AD01624 | AM02659-AS | 715 | AM02664-SS | 1099 | 10 | | 1.134 |
| AD01627 | AM02662-AS | 718 | AM02664-SS | 1099 | 10 | | 1.135 |
| AD01628 | AM02474-AS | 680 | AM02665-SS | 1100 | 10 | | 0.936 |
| AD01629 | AM02658-AS | 714 | AM02665-SS | 1100 | 10 | | 1.076 |
| AD01630 | AM02659-AS | 715 | AM02665-SS | 1100 | 10 | | 1.107 |
| AD01633 | AM02662-AS | 718 | AM02665-SS | 1100 | 10 | | 1.113 |
| AD01775 | AM02474-AS | 680 | AM02867-SS | 1138 | 10 | | 0.660 |
| AD01776 | AM02474-AS | 680 | AM02868-SS | 1139 | 10 | | 0.619 |
| AD01777 | AM02474-AS | 680 | AM02869-SS | 1140 | 10 | | 0.735 |
| AD01834 | AM02953-AS | 766 | AM02956-SS | 1144 | 10 | | 0.324 |
| AD01838 | AM02953-AS | 766 | AM02956-SS | 1144 | 10 | | 0.355 |
| AD01839 | AM02962-AS | 767 | AM02956-SS | 1144 | 10 | | 0.320 |
| AD01840 | AM02963-AS | 768 | AM02956-SS | 1144 | 10 | | 0.392 |
| AD01841 | AM02964-AS | 769 | AM02956-SS | 1144 | 10 | | 0.463 |
| AD01842 | AM02965-AS | 770 | AM02956-SS | 1144 | 10 | | 0.116 |

TABLE 10-continued

Relative serum F12 protein levels in mice following intravenous administration of the indicated F12 RNAi trigger with MLP (delivery polymer) or subcutaneous administration of the indicated F12 RNAi trigger (no delivery polymer). mF12 levels were normalized to pre-treatment and saline control. (F12 RNAi trigger Duplex ID No. with sense strand and antisense strand ID Nos.)

| Duplex ID No. | Antisense Strand ID | SEQ ID | Sense Strand ID | SEQ ID | RNAi trigger (mg/kg) | Delivery Polymer (mg/kg) | Relative Factor 12 |
|---|---|---|---|---|---|---|---|
| AD01843 | AM02966-AS | 771 | AM02956-SS | 1144 | 10 | | 0.179 |
| AD01844 | AM02967-AS | 772 | AM02956-SS | 1144 | 10 | | 0.179 |
| AD01845 | AM02968-AS | 773 | AM02956-SS | 1144 | 10 | | 0.223 |
| AD01846 | AM02969-AS | 774 | AM02956-SS | 1144 | 10 | | 0.270 |
| AD01847 | AM02970-AS | 775 | AM02956-SS | 1144 | 10 | | 0.193 |
| AD01848 | AM02971-AS | 776 | AM02956-SS | 1144 | 10 | | 0.165 |
| AD01849 | AM02953-AS | 766 | AM02960-SS | 1145 | 10 | | 0.380 |
| AD01850 | AM02953-AS | 766 | AM02960-SS | 1145 | 10 | | 0.482 |
| AD01851 | AM02962-AS | 767 | AM02960-SS | 1145 | 10 | | 0.104 |
| AD01852 | AM02963-AS | 768 | AM02960-SS | 1145 | 10 | | 0.212 |
| AD01853 | AM02964-AS | 769 | AM02960-SS | 1145 | 10 | | 0.119 |
| AD01854 | AM02965-AS | 770 | AM02960-SS | 1145 | 10 | | 0.067 |
| AD01855 | AM02966-AS | 771 | AM02960-SS | 1145 | 10 | | 0.049 |
| AD01856 | AM02967-AS | 772 | AM02960-SS | 1145 | 10 | | 0.034 |
| AD01857 | AM02968-AS | 773 | AM02960-SS | 1145 | 10 | | 0.068 |
| AD01858 | AM02969-AS | 774 | AM02960-SS | 1145 | 10 | | 0.096 |
| AD01859 | AM02970-AS | 775 | AM02960-SS | 1145 | 10 | | 0.057 |
| AD01860 | AM02971-AS | 776 | AM02960-SS | 1145 | 10 | | 0.052 |
| AD01861 | AM02953-AS | 766 | AM02961-SS | 1146 | 10 | | 0.433 |
| AD01862 | AM02953-AS | 766 | AM02961-SS | 1146 | 10 | | 0.332 |
| AD01863 | AM02962-AS | 767 | AM02961-SS | 1146 | 10 | | 0.087 |
| AD01864 | AM02963-AS | 768 | AM02961-SS | 1146 | 10 | | 0.093 |
| AD01865 | AM02964-AS | 769 | AM02961-SS | 1146 | 10 | | 0.048 |
| AD01866 | AM02965-AS | 770 | AM02961-SS | 1146 | 10 | | 0.027 |
| AD01867 | AM02966-AS | 771 | AM02961-SS | 1146 | 10 | | 0.096 |
| AD01868 | AM02967-AS | 772 | AM02961-SS | 1146 | 10 | | 0.044 |
| AD01869 | AM02968-AS | 773 | AM02961-SS | 1146 | 10 | | 0.044 |
| AD01870 | AM02969-AS | 774 | AM02961-SS | 1146 | 10 | | 0.080 |
| AD01871 | AM02970-AS | 775 | AM02961-SS | 1146 | 10 | | 0.050 |
| AD01872 | AM02971-AS | 776 | AM02961-SS | 1146 | 10 | | 0.050 |
| AD01874 | AM02656-AS | 712 | AM02974-SS | 1147 | 10 | | 0.498 |
| AD01942 | AM02707-AS | 735 | AM03071-SS | 1164 | 10 | | 0.826 |
| AD01943 | AM02711-AS | 739 | AM03072-SS | 1165 | 10 | | 0.195 |
| AD01944 | AM02714-AS | 742 | AM03073-SS | 1166 | 10 | | 0.520 |
| AD01945 | AM02715-AS | 743 | AM03074-SS | 1167 | 10 | | 0.781 |
| AD01946 | AM03075-AS | 781 | AM03071-SS | 1164 | 10 | | 0.967 |
| AD01947 | AM03076-AS | 782 | AM03072-SS | 1165 | 10 | | 0.459 |
| AD01948 | AM03077-AS | 783 | AM03073-SS | 1166 | 10 | | 0.727 |
| AD01949 | AM03078-AS | 784 | AM03074-SS | 1167 | 10 | | 0.972 |
| AD01953 | AM02656-AS | 712 | AM03083-SS | 1168 | 5 | | 0.353 |
| AD01954 | AM02656-AS | 712 | AM03084-SS | 1169 | 5 | | 0.449 |
| AD01955 | AM02656-AS | 712 | AM03085-SS | 1170 | 5 | | 0.538 |
| AD01966 | AM02656-AS | 712 | AM03114-SS | 1174 | 5 | | 0.510 |
| AD01967 | AM02656-AS | 712 | AM03115-SS | 1175 | 5 | | 0.481 |
| AD01970 | AM03109-AS | 785 | AM02653-SS | 1095 | 5 | | 0.786 |
| AD01971 | AM03110-AS | 786 | AM02653-SS | 1095 | 5 | | 0.611 |
| AD01972 | AM03111-AS | 787 | AM02653-SS | 1095 | 5 | | 0.665 |
| AD01973 | AM02656-AS | 712 | AM03112-SS | 1172 | 5 | | 0.112 |
| AD01974 | AM02656-AS | 712 | AM03113-SS | 1173 | 5 | | 0.436 |
| AD01975 | AM03109-AS | 785 | AM03112-SS | 1172 | 5 | | 0.444 |
| AD01991 | AM02656-AS | 712 | AM03132-SS | 1178 | 5 | | 0.151 |
| AD01992 | AM02656-AS | 712 | AM03133-SS | 1179 | 5 | | 0.381 |
| AD01993 | AM02656-AS | 712 | AM03135-SS | 1180 | 5 | | 0.149 |
| AD01994 | AM02656-AS | 712 | AM03137-SS | 1182 | 5 | | 0.903 |
| AD01999 | AM02656-AS | 712 | AM03142-SS | 1187 | 5 | | 0.587 |
| AD02000 | AM02657-AS | 713 | AM03143-SS | 1188 | 5 | | 0.673 |
| AD02012 | AM02967-AS | 772 | AM03152-SS | 1192 | 3 | | 0.288 |
| AD02013 | AM02967-AS | 772 | AM03153-SS | 1193 | 3 | | 0.265 |
| AD02014 | AM03154-AS | 788 | AM02961-SS | 1146 | 3 | | 0.125 |
| AD02015 | AM03154-AS | 788 | AM03152-SS | 1192 | 3 | | 0.307 |
| AD02016 | AM03154-AS | 788 | AM03153-SS | 1193 | 3 | | 0.433 |
| AD02017 | AM03155-AS | 789 | AM02961-SS | 1146 | 3 | | 0.118 |
| AD02018 | AM03155-AS | 789 | AM03152-SS | 1192 | 3 | | 0.462 |
| AD02019 | AM03155-AS | 789 | AM03153-SS | 1193 | 3 | | 0.438 |
| AD02020 | AM03156-AS | 790 | AM02961-SS | 1146 | 3 | | 0.100 |
| AD02021 | AM03156-AS | 790 | AM03152-SS | 1192 | 3 | | 0.262 |
| AD02022 | AM03156-AS | 790 | AM03153-SS | 1193 | 3 | | 0.242 |
| AD02023 | AM03157-AS | 791 | AM02961-SS | 1146 | 3 | | 0.070 |
| AD02024 | AM03157-AS | 791 | AM03152-SS | 1192 | 3 | | 0.252 |
| AD02025 | AM03157-AS | 791 | AM03153-SS | 1193 | 3 | | 0.202 |

TABLE 10-continued

Relative serum F12 protein levels in mice following intravenous administration of the indicated F12 RNAi trigger with MLP (delivery polymer) or subcutaneous administration of the indicated F12 RNAi trigger (no delivery polymer). mF12 levels were normalized to pre-treatment and saline control. (F12 RNAi trigger Duplex ID No. with sense strand and antisense strand ID Nos.)

| Duplex ID No. | Antisense Strand ID | SEQ ID | Sense Strand ID | SEQ ID | RNAi trigger (mg/kg) | Delivery Polymer (mg/kg) | Relative Factor 12 |
|---|---|---|---|---|---|---|---|
| AD02045 | AM02656-AS | 712 | AM03177-SS | 1194 | 5 | | 0.644 |
| AD02046 | AM02656-AS | 712 | AM03178-SS | 1195 | 5 | | 0.615 |
| AD02047 | AM02656-AS | 712 | AM03179-SS | 1196 | 5 | | 0.521 |
| AD02056 | AM02971-AS | 776 | AM03209-SS | 1201 | 3 | | 0.103 |
| AD02057 | AM03211-AS | 800 | AM03209-SS | 1201 | 3 | | 0.225 |
| AD02058 | AM03211-AS | 800 | AM02961-SS | 1146 | 3 | | 0.116 |
| AD02059 | AM03211-AS | 800 | AM03210-SS | 1202 | 3 | | 0.104 |
| AD02060 | AM02971-AS | 776 | AM03210-SS | 1202 | 3 | | 0.066 |
| AD02061 | AM03212-AS | 801 | AM02961-SS | 1146 | 3 | | 0.127 |
| AD02062 | AM02971-AS | 776 | AM03213-SS | 1203 | 3 | | 0.043 |
| AD02063 | AM03212-AS | 801 | AM03213-SS | 1203 | 3 | | 0.171 |
| AD02064 | AM03215-AS | 802 | AM03214-SS | 1204 | 5 | | 0.149 |
| AD02065 | AM02656-AS | 712 | AM03217-SS | 1205 | 5 | | 0.195 |
| AD02069 | AM02656-AS | 712 | AM03218-SS | 1206 | 5 | | 0.693 |
| AD02459 | AM02966-AS | 771 | AM03046-SS | 1157 | 5 | | 0.310 |
| AD02460 | AM02967-AS | 772 | AM03327-SS | 1207 | 3 | | 0.232 |
| AD02461 | AM02967-AS | 772 | AM03329-SS | 1209 | 3 | | 0.336 |
| AD02562 | AM02967-AS | 772 | AM03339-SS | 1211 | 2 | | 0.357 |
| AD02564 | AM03342-AS | 803 | AM03072-SS | 1165 | 2 | | 0.867 |
| AD02565 | AM03343-AS | 804 | AM03072-SS | 1165 | 2 | | 1.131 |
| AD02566 | AM03344-AS | 805 | AM03072-SS | 1165 | 2 | | 0.884 |
| AD02567 | AM03345-AS | 806 | AM03072-SS | 1165 | 2 | | 0.839 |
| AD02568 | AM03346-AS | 807 | AM03072-SS | 1165 | 2 | | 1.030 |
| AD02569 | AM03347-AS | 808 | AM03072-SS | 1165 | 2 | | 0.759 |
| AD02570 | AM03348-AS | 809 | AM03072-SS | 1165 | 2 | | 1.025 |
| AD02571 | AM03349-AS | 810 | AM03072-SS | 1165 | 2 | | 1.074 |
| AD02572 | AM03350-AS | 811 | AM03072-SS | 1165 | 2 | | 1.027 |
| AD02573 | AM03351-AS | 812 | AM03072-SS | 1165 | 2 | | 0.820 |
| AD02574 | AM03352-AS | 813 | AM03072-SS | 1165 | 2 | | 0.807 |
| AD02575 | AM03353-AS | 814 | AM03072-SS | 1165 | 2 | | 0.918 |
| AD02576 | AM02711-AS | 739 | AM03354-SS | 1212 | 2 | | 0.447 |
| AD02577 | AM02711-AS | 739 | AM03355-SS | 1213 | 2 | | 0.718 |
| AD02578 | AM02711-AS | 739 | AM03356-SS | 1214 | 2 | | 0.293 |
| AD02579 | AM02711-AS | 739 | AM03357-SS | 1215 | 2 | | 0.322 |
| AD02580 | AM02711-AS | 739 | AM03358-SS | 1216 | 2 | | 0.854 |
| AD02581 | AM03359-AS | 815 | AM03072-SS | 1165 | 2 | | 0.833 |
| AD02582 | AM03359-AS | 815 | AM03354-SS | 1212 | 2 | | 0.503 |
| AD02583 | AM03359-AS | 815 | AM03355-SS | 1213 | 2 | | 0.588 |
| AD02584 | AM03359-AS | 815 | AM03356-SS | 1214 | 2 | | 0.382 |
| AD02585 | AM03359-AS | 815 | AM03357-SS | 1215 | 2 | | 0.488 |
| AD02586 | AM03359-AS | 815 | AM03358-SS | 1216 | 2 | | 0.810 |
| AD02587 | AM02714-AS | 742 | AM03360-SS | 1217 | 2 | | 1.056 |
| AD02588 | AM02714-AS | 742 | AM03361-SS | 1218 | 2 | | 1.023 |
| AD02589 | AM02714-AS | 742 | AM03362-SS | 1219 | 2 | | 1.380 |
| AD02590 | AM02714-AS | 742 | AM03363-SS | 1220 | 2 | | 0.963 |
| AD02591 | AM02714-AS | 742 | AM03364-SS | 1221 | 2 | | 1.111 |
| AD02592 | AM03365-AS | 816 | AM03073-SS | 1166 | 2 | | 1.084 |
| AD02593 | AM03365-AS | 816 | AM03360-SS | 1217 | 2 | | 0.922 |
| AD02594 | AM03365-AS | 816 | AM03361-SS | 1218 | 2 | | 1.197 |
| AD02595 | AM03365-AS | 816 | AM03362-SS | 1219 | 2 | | 1.003 |
| AD02596 | AM03365-AS | 816 | AM03363-SS | 1220 | 2 | | 0.888 |
| AD02597 | AM03365-AS | 816 | AM03364-SS | 1221 | 2 | | 1.073 |
| AD02598 | AM03366-AS | 817 | AM03073-SS | 1166 | 2 | | 1.283 |
| AD02599 | AM03366-AS | 817 | AM03360-SS | 1217 | 2 | | 1.004 |
| AD02600 | AM03366-AS | 817 | AM03361-SS | 1218 | 2 | | 1.074 |
| AD02601 | AM03366-AS | 817 | AM03362-SS | 1219 | 2 | | 1.066 |
| AD02602 | AM03366-AS | 817 | AM03363-SS | 1220 | 2 | | 0.972 |
| AD02603 | AM03366-AS | 817 | AM03364-SS | 1221 | 2 | | 0.918 |
| AD02634 | AM02967-AS | 772 | AM02960-SS | 1145 | 2 | | 0.348 |
| AD02635 | AM03154-AS | 788 | AM02960-SS | 1145 | 3 | | 0.348 |
| AD02636 | AM03155-AS | 789 | AM02960-SS | 1145 | 3 | | 0.247 |
| AD02637 | AM03156-AS | 790 | AM02960-SS | 1145 | 3 | | 0.156 |
| AD02638 | AM03157-AS | 791 | AM02960-SS | 1145 | 3 | | 0.181 |
| AD02642 | AM03157-AS | 791 | AM03402-SS | 1232 | 10 | | 0.033 |
| AD02643 | AM03157-AS | 791 | AM03339-SS | 1211 | 3 | | 0.176 |
| AD02644 | AM03157-AS | 791 | AM03403-SS | 1233 | 3 | | 0.164 |
| AD02645 | AM03157-AS | 791 | AM03404-SS | 1234 | 3 | | 0.264 |
| AD02646 | AM03157-AS | 791 | AM03405-SS | 1235 | 3 | | 0.580 |
| AD02647 | AM03157-AS | 791 | AM03406-SS | 1236 | 3 | | 0.174 |
| AD02648 | AM03410-AS | 820 | AM03407-SS | 1237 | 3 | | 0.614 |

TABLE 10-continued

Relative serum F12 protein levels in mice following intravenous administration of the indicated F12 RNAi trigger with MLP (delivery polymer) or subcutaneous administration of the indicated F12 RNAi trigger (no delivery polymer). mF12 levels were normalized to pre-treatment and saline control. (F12 RNAi trigger Duplex ID No. with sense strand and antisense strand ID Nos.)

| Duplex ID No. | Antisense Strand ID | SEQ ID | Sense Strand ID | SEQ ID | RNAi trigger (mg/kg) | Delivery Polymer (mg/kg) | Relative Factor 12 |
|---|---|---|---|---|---|---|---|
| AD02649 | AM03410-AS | 820 | AM03408-SS | 1238 | 3 | | 0.537 |
| AD02650 | AM03410-AS | 820 | AM03409-SS | 1239 | 3 | | 0.629 |
| AD02651 | AM03157-AS | 791 | AM03411-SS | 1240 | 3 | | 0.299 |
| AD02652 | AM03157-AS | 791 | AM03412-SS | 1241 | 3 | | 0.289 |
| AD02653 | AM03157-AS | 791 | AM03413-SS | 1242 | 3 | | 0.171 |
| AD02654 | AM03157-AS | 791 | AM03414-SS | 1243 | 3 | | 0.226 |
| AD02655 | AM03415-AS | 821 | AM03402-SS | 1232 | 3 | | 0.290 |
| AD02656 | AM03416-AS | 822 | AM03402-SS | 1232 | 3 | | 0.294 |
| AD02657 | AM03417-AS | 823 | AM03402-SS | 1232 | 3 | | 0.134 |
| AD02658 | AM03418-AS | 824 | AM03402-SS | 1232 | 3 | | 0.218 |
| AD02659 | AM03419-AS | 825 | AM03402-SS | 1232 | 3 | | 0.278 |
| AD02665 | AM03410-AS | 820 | AM03428-SS | 1248 | 3 | | 0.241 |
| AD02666 | AM03410-AS | 820 | AM03429-SS | 1249 | 3 | | 0.151 |
| AD02667 | AM03410-AS | 820 | AM03430-SS | 1250 | 3 | | 0.160 |
| AD02688 | AM03157-AS | 791 | AM03456-SS | 1261 | 3 | | 0.304 |
| AD02689 | AM03157-AS | 791 | AM03464-SS | 1263 | 3 | | 0.207 |
| AD02690 | AM03157-AS | 791 | AM03463-SS | 1262 | 3 | | 0.254 |
| AD02700 | AM03410-AS | 820 | AM03476-SS | 1264 | 3 | | 0.335 |
| AD02701 | AM03410-AS | 820 | AM03477-SS | 1265 | 3 | | 0.430 |
| AD02702 | AM03410-AS | 820 | AM03478-SS | 1266 | 3 | | 0.297 |
| AD02703 | AM03410-AS | 820 | AM03479-SS | 1267 | 3 | | 0.308 |
| AD02704 | AM03410-AS | 820 | AM03480-SS | 1268 | 3 | | 0.288 |
| AD02705 | AM03410-AS | 820 | AM03481-SS | 1269 | 3 | | 0.435 |
| AD02706 | AM03410-AS | 820 | AM03482-SS | 1270 | 3 | | 0.915 |
| AD02707 | AM03483-AS | 826 | AM03402-SS | 1232 | 3 | | 0.245 |
| AD02708 | AM03484-AS | 827 | AM03402-SS | 1232 | 3 | | 0.121 |
| AD02709 | AM03485-AS | 828 | AM03402-SS | 1232 | 3 | | 0.974 |
| AD02774 | AM03589-AS | 833 | AM03591-SS | 1290 | 3 | | 0.625 |
| AD02775 | AM03590-AS | 834 | AM03591-SS | 1290 | 3 | | 0.649 |
| AD02776 | AM03590-AS | 834 | AM03592-SS | 1291 | 3 | | 0.565 |
| AD02777 | AM03157-AS | 791 | AM03588-SS | 1289 | 3 | | 0.277 |
| AD02803 | AM03157-AS | 791 | AM03629-SS | 1293 | 3 | | 0.377 |
| AD02804 | AM03157-AS | 791 | AM03630-SS | 1294 | 3 | | 0.337 |
| AD02806 | AM03157-AS | 791 | AM03631-SS | 1295 | 3 | | 0.317 |
| AD02807 | AM03157-AS | 791 | AM03632-SS | 1296 | 3 | | 0.205 |
| AD02808 | AM03157-AS | 791 | AM03633-SS | 1297 | 3 | | 0.519 |
| AD02809 | AM03410-AS | 820 | AM03634-SS | 1298 | 3 | | 0.610 |
| AD02810 | AM03157-AS | 791 | AM03635-SS | 1299 | 3 | | 0.268 |
| AD02811 | AM03157-AS | 791 | AM03636-SS | 1300 | 3 | | 0.242 |
| AD02812 | AM03157-AS | 791 | AM03637-SS | 1301 | 3 | | 0.238 |
| AD02813 | AM03410-AS | 820 | AM03638-SS | 1302 | 3 | | 0.759 |
| AD02814 | AM03157-AS | 791 | AM03639-SS | 1303 | 3 | | 0.223 |
| AD02815 | AM03157-AS | 791 | AM03640-SS | 1304 | 3 | | 0.212 |
| AD02816 | AM03157-AS | 791 | AM03641-SS | 1305 | 3 | | 0.455 |
| AD02817 | AM03410-AS | 820 | AM03642-SS | 1306 | 3 | | 0.524 |
| AD02822 | AM03581-AS | 830 | AM03653-SS | 1359 | 3 | | 0.164 |
| AD02823 | AM03157-AS | 791 | AM03653-SS | 1359 | 3 | | 0.285 |
| AD02824 | AM03157-AS | 791 | AM03654-SS | 1360 | 3 | | 0.152 |
| AD02867 | AM03157-AS | 791 | AM03703-SS | 1363 | 3 | | 0.036 |
| AD02868 | AM03157-AS | 791 | AM03704-SS | 1364 | 3 | | 0.034 |
| AD02872 | AM03417-AS | 823 | AM03413-SS | 1242 | 3 | | 0.170 |

TABLE 11

Serum F12 protein levels in wild-type mice following administration of 8 mg/kg RNAi trigger with 8 mg/kg MLP delivery polymer. mF12 levels were normalized to pre-treatment and saline control.

| treatment | Day -4 | day 4 | day 8 | day 15 | day 22 | day 29 | day 36 | day 43 | day 50 | day 57 | day 63 | day 71 |
|---|---|---|---|---|---|---|---|---|---|---|---|---|
| Saline | 1.000 | 1.000 ± 0.158 | 1.000 ± 0.133 | 1.000 ± 0.239 | 1.000 ± 0.179 | 1.000 ± 0.131 | 1.000 ± 0.303 | 1.000 ± 0.150 | 1.000 ± 0.076 | 1.000 ± 0.047 | 1.000 ± 0.099 | 1.000 ± 0.100 |
| RD10694 (control) | 1000 | 1.075 ± 0.032 | 1.26 ± 0.071 | 0.778 ± 0.60 | 0.977 ± 0.037 | 0.778 ± 0.060 | 1.030 ± 0.102 | 0.846 ± 0.067 | 0.832 ± 0.221 | 0.968 ± 0.070 | 0.916 ± 0.064 | 0.936 ± 0.062 |
| AD00897 | 1.000 | 0.092 ± 0.006 | 0.007 ± 0.001 | 0.007 ± 0.005 | 0.031 ± 0.015 | 0.148 ± 0.081 | 0.639 ± 0.186 | 0.875 ± 0.172 | 0.873 ± 0.134 | 0.924 ± 0.107 | 0.952 ± 0.130 | 1.013 ± 0.195 |
| AD00898 | 1.000 | 0.104 ± 0.013 | 0.007 ± 0.002 | 0.024 ± 0.004 | 0.142 ± 0.039 | 0.571 ± 0.165 | 0.907 ± 0.147 | 1.098 ± 0.084 | 0.997 ± 0.079 | 1.073 ± 0.051 | 1.077 ± 0.041 | 1.059 ± 0.063 |
| AD00899 | 1.000 | 0.090 ± 0.004 | 0.009 ± 0.000 | 0.041 ± 0.019 | 0.114 ± 0.070 | 0.262 ± 0.055 | 0.580 ± 0.096 | 0.791 ± 0.067 | 0.905 ± 0.069 | 0.959 ± 0.053 | 0.978 ± 0.079 | 1.059 ± 0.091 |
| AD00900 | 1.000 | 0.084 ± 0.012 | 0.007 ± 0.002 | 0.014 ± 0.005 | 0.016 ± 0.003 | 0.033 ± 0.010 | 0.123 ± 0.025 | 0.207 ± 0.038 | 0.331 ± 0.068 | 0.569 ± 0.104 | 0.784 ± 0.027 | 0.961 ± 0.094 |
| AD00901 | 1.000 | 0.101 ± 0.014 | 0.020 ± 0.004 | 0.043 ± 0.005 | 0.068 ± 0.019 | 0.176 ± 0.059 | 0.491 ± 0.097 | 0.630 ± 0.147 | 0.566 ± 0.369 | 0.871 ± 0.119 | 0.909 ± 0.084 | 1.083 ± 0.120 |
| AD00902 | 1.000 | 0.111 ± 0.022 | 0.012 ± 0.005 | 0.022 ± 0.007 | 0.040 ± 0.024 | 0.132 ± 0.054 | 0.441 ± 0.131 | 0.647 ± 0.194 | 0.778 ± 0.167 | 0.887 ± 0.139 | 0.967 ± 0.148 | 1.055 ± 0.166 |

TABLE 12

Serum F12 protein levels in C57/B6 mice following administration of 2 mg/kg canonical or UNA-containing RNAi triggers with 2 mg/kg MLP delivery polymer. mF12 levels were normalized to pre-treatment and saline control.

| | Day 3 | Day 8 | Day 15 | Day 22 | Day 29 | Day 36 | Day 43 | Day 50 | Day 57 |
|---|---|---|---|---|---|---|---|---|---|
| saline | 1.00 ± 0.09 | 1.00 ± 0.13 | 1.00 ± 0.12 | 1.00 ± 0.07 | 1.00 ± 0.26 | 1.00 ± 0.10 | 1.00 ± 0.20 | 1.00 ± 0.11 | 1.00 ± 0.04 |
| RD10694 | 0.93 ± 0.06 | 1.03 ± 0.05 | 0.97 ± 0.05 | 0.95 ± 0.08 | 1.44 ± 0.09 | 1.09 ± 0.58 | | | |
| AD00897 | 0.17 ± 0.05 | 0.07 ± 0.00 | 0.27 ± 0.03 | 0.67 ± 0.13 | 1.07 ± 0.27 | 1.44 ± 0.27 | | | |
| AD00898 | 0.21 ± 0.01 | 0.26 ± 0.16 | 0.66 ± 0.19 | 0.89 ± 0.06 | 1.23 ± 0.45 | 1.14 ± 0.77 | | | |
| AD00899 | 0.18 ± 0.01 | 0.10 ± 0.04 | 0.23 ± 0.08 | 0.38 ± 0.11 | 1.09 ± 0.15 | 1.25 ± 0.61 | 0.98 ± 0.07 | 0.92 ± 0.13 | 0.97 ± 0.22 |
| AD00900 | 0.21 ± 0.03 | 0.09 ± 0.04 | 0.20 ± 0.06 | 0.35 ± 0.09 | 1.01 ± 0.21 | 1.11 ± 0.13 | 0.87 ± 0.09 | 0.93 ± 0.03 | 0.89 ± 0.28 |
| AD00901 | 0.35 ± 0.03 | 0.37 ± 0.07 | 0.55 ± 0.04 | 0.74 ± 0.03 | 1.72 ± 0.11 | 0.65 ± 0.09 | | | |
| AD00902 | 0.21 ± 0.01 | 0.10 ± 0.03 | 0.22 ± 0.04 | 0.42 ± 0.09 | 0.84 ± 0.02 | 1.15 ± 0.34 | | | |
| AD00897 | 0.28 ± 0.04 | 0.31 ± 0.11 | 0.70 ± 0.11 | 1.00 ± 0.08 | 1.52 ± 0.48 | 1.09 ± 0.77 | | | |
| AD00999 | 0.17 ± 0.03 | 0.19 ± 0.03 | 0.71 ± 0.05 | 0.98 ± 0.02 | 1.58 ± 0.03 | 1.53 ± 0.42 | | | |
| AD01000 | 0.17 ± 0.02 | 0.05 ± 0.01 | 0.18 ± 0.03 | 0.40 ± 0.10 | 0.66 ± 0.05 | 0.74 ± 0.12 | 0.91 ± 0.06 | 0.92 ± 0.11 | 1.10 ± 0.13 |
| AD01001 | 0.16 ± 0.02 | 0.05 ± 0.02 | 0.12 ± 0.04 | 0.23 ± 0.08 | 0.63 ± 0.17 | 0.85 ± 0.20 | 0.73 ± 0.13 | 0.83 ± 0.25 | 1.03 ± 0.23 |
| AD01002 | 0.25 ± 0.04 | 0.25 ± 0.09 | 0.38 ± 0.09 | 0.64 ± 0.08 | 1.07 ± 0.37 | 0.96 ± 0.66 | | | |
| AD01003 | 0.29 ± 0.06 | 0.13 ± 0.07 | 0.26 ± 0.10 | 0.58 ± 0.21 | 1.27 ± 0.05 | 1.67 ± 0.13 | | | |
| AD01004 | 0.29 ± 0.02 | 0.14 ± 0.02 | 0.24 ± 0.07 | 0.52 ± 0.07 | 0.93 ± 0.19 | 1.48 ± 0.14 | | | |
| AD01005 | 0.39 ± 0.06 | 0.46 ± 0.17 | 0.89 ± 0.20 | 1.11 ± 0.08 | 1.33 ± 0.32 | 1.16 ± 0.61 | | | |
| AD01006 | 0.35 ± 0.02 | 0.27 ± 0.14 | 0.46 ± 0.25 | 0.66 ± 0.25 | 1.27 ± 0.26 | 1.76 ± 0.17 | 0.93 ± 0.06 | 0.93 ± 0.01 | 0.99 ± 0.29 |
| AD01007 | 0.27 ± 0.02 | 0.13 ± 0.01 | 0.15 ± 0.03 | 0.22 ± 0.05 | 0.58 ± 0.10 | 0.69 ± 0.15 | 0.61 ± 0.11 | 0.85 ± 0.04 | 0.9 ± 0.26 |
| AD01008 | 0.36 ± 0.04 | 0.26 ± 0.08 | 0.35 ± 0.09 | 0.53 ± 0.14 | 1.02 ± 0.10 | 1.10 ± 0.61 | | | |
| AD01109 | 0.35 ± 0.09 | 0.23 ± 0.09 | 0.39 ± 0.17 | 0.73 ± 0.16 | 1.10 ± 0.41 | 1.29 ± 0.23 | | | |

TABLE 13

Relative serum F12 protein levels in C57/B6 mice following administration of 0.5 mg/kg modified F12 RNAi triggers with 2 mg/kg MLP delivery polymer. mF12 levels were normalized to pre-treatment and saline control.

| Treatment | Day 4 | Day 8 | Day 15 | Day 22 | Day 29 | Day 36 | Day 43 |
|---|---|---|---|---|---|---|---|
| Saline | 1.00 ± 0.07 | 1.00 ± 0.06 | 1.00 ± 0.39 | 1.00 ± 0.17 | 1.00 ± 0.08 | 1.00 ± 0.07 | 1.00 ± 0.03 |
| AD01000 | 0.26 ± 0.07 | 0.34 ± 0.15 | 1.25 ± 0.38 | 0.79 ± 0.14 | 0.89 ± 0.05 | 0.95 ± 0.12 | |
| AD01001 | 0.18 ± 0.02 | 0.17 ± 0.02 | 0.34 ± 0.05 | 0.35 ± 0.10 | 0.62 ± 0.02 | 0.85 ± 0.05 | 1.03 ± 0.10 |
| AD01003 | 0.19 ± 0.01 | 0.20 ± 0.03 | 0.62 ± 0.02 | 0.56 ± 0.16 | 0.86 ± 0.09 | 0.97 ± 0.14 | |
| AD01007 | 0.27 ± 0.09 | 0.15 ± 0.08 | 0.39 ± 0.06 | 0.40 ± 0.01 | 0.76 ± 0.13 | 0.98 ± 0.26 | 1.25 ± 0.49 |
| AD01115 | 0.20 ± 0.12 | 0.28 ± 0.18 | 0.95 ± 0.62 | 0.92 ± 0.48 | 1.19 ± 0.62 | 1.32 ± 0.65 | |
| AD01116 | 0.23 ± 0.12 | 0.20 ± 0.14 | 0.45 ± 0.33 | 0.54 ± 0.37 | 0.74 ± 0.37 | 1.03 ± 0.52 | 1.20 ± 0.79 |
| AD01117 | 0.27 ± 0.03 | 0.29 ± 0.03 | 0.73 ± 0.03 | 0.73 ± 0.03 | 0.96 ± 0.11 | 1.09 ± 0.07 | |
| AD01118 | 0.28 ± 0.11 | 0.27 ± 0.11 | 0.55 ± 0.22 | 0.63 ± 0.10 | 0.84 ± 0.18 | 1.15 ± 0.29 | 0.85 ± 0.18 |

TABLE 13-continued

Relative serum F12 protein levels in C57/B6 mice following administration of 0.5 mg/kg modified F12 RNAi triggers with 2 mg/kg MLP delivery polymer. mF12 levels were normalized to pre-treatment and saline control.

| Treatment | Day 4 | Day 8 | Day 15 | Day 22 | Day 29 | Day 36 | Day 43 |
|---|---|---|---|---|---|---|---|
| AD01124 | 0.23 ± 0.09 | 0.16 ± 0.09 | 0.38 ± 0.19 | 0.40 ± 0.18 | 0.68 ± 0.28 | 0.98 ± 0.26 | 1.09 ± 0.38 |
| AD01125 | 0.27 ± 0.12 | 0.33 ± 0.12 | 0.96 ± 0.09 | 0.85 ± 0.04 | 1.02 ± 0.10 | 1.16 ± 0.13 | |
| AD01126 | 0.25 ± 0.02 | 0.30 ± 0.05 | 0.73 ± 0.10 | 0.68 ± 0.06 | 0.91 ± 0.06 | 1.12 ± 0.15 | 1.20 ± 0.07 |
| AD01127 | 0.55 ± 0.19 | 0.53 ± 0.25 | 1.24 ± 0.25 | 0.85 ± 0.04 | 1.09 ± 0.14 | 1.13 ± 0.08 | |

TABLE 14

Relative serum F12 protein levels in C57/B6 mice following administration of 0.5 mg/kg modified F12 RNAi triggers with 2 mg/kg MLP delivery polymer. mF12 levels were normalized to pre-treatment and saline control.

| Treatment | Day 4 | Day 8 | Day 15 | Day 22 | Day 29 | Day 36 | Day 43 | Day 53 |
|---|---|---|---|---|---|---|---|---|
| Saline | 1.00 ± 0.12 | 1.00 ± 0.33 | 1.00 ± 0.07 | 1.00 ± 0.08 | 1.00 ± 0.06 | 1.00 ± 0.05 | 1.00 ± 0.07 | 1.00 ± 0.09 |
| AD01001 | 0.13 ± 0.03 | 0.09 ± 0.04 | 0.20 ± 0.09 | 0.32 ± 0.11 | 0.55 ± 0.09 | 0.73 ± 0.09 | 0.84 ± 0.12 | 0.93 ± 0.07 |
| AD01007 | 0.39 ± 0.25 | 0.38 ± 0.29 | 0.59 ± 0.35 | 0.71 ± 0.37 | 0.83 ± 0.21 | 1.11 ± 0.32 | 0.90 ± 0.12 | 1.02 ± 0.16 |
| AD01111 | 0.17 ± 0.01 | 0.16 ± 0.05 | 0.37 ± 0.08 | 0.54 ± 0.16 | 0.89 ± 0.09 | 1.02 ± 0.10 | 0.93 ± 0.06 | 0.96 ± 0.08 |
| AD01112 | 0.29 ± 0.21 | 0.34 ± 0.32 | 0.63 ± 0.35 | 0.61 ± 0.13 | 1.02 ± 0.17 | 1.12 ± 0.12 | 1.03 ± 0.13 | 1.03 ± 0.10 |
| AD01119 | 0.44 ± 0.10 | 0.46 ± 0.12 | 0.64 ± 0.09 | 1.02 ± 0.11 | 0.95 ± 0.02 | 1.00 ± 0.08 | 0.90 ± 0.08 | 0.93 ± 0.05 |
| AD01120 | 0.37 ± 0.18 | 0.50 ± 0.20 | 0.75 ± 0.24 | 0.94 ± 0.12 | 1.00 ± 0.06 | 0.96 ± 0.09 | 0.98 ± 0.09 | 0.93 ± 0.09 |
| AD01121 | 0.44 ± 0.11 | 0.28 ± 0.18 | 0.50 ± 0.14 | 0.65 ± 0.12 | 0.92 ± 0.10 | 1.02 ± 0.06 | 0.91 ± 0.10 | 0.95 ± 0.01 |
| AD01122 | 0.14 ± 0.04 | 0.15 ± 0.08 | 0.29 ± 0.09 | 0.43 ± 0.05 | 0.73 ± 0.12 | 0.90 ± 0.02 | 0.82 ± 0.08 | 0.97 ± 0.10 |
| AD01123 | 0.23 ± 0.04 | 0.26 ± 0.07 | 0.48 ± 0.11 | 0.67 ± 0.10 | 0.90 ± 0.11 | 0.91 ± 0.15 | 0.90 ± 0.06 | 1.08 ± 0.11 |
| AD01128 | 0.33 ± 0.11 | 0.33 ± 0.17 | 0.42 ± 0.37 | 0.86 ± 0.38 | 0.96 ± 0.11 | 0.98 ± 0.04 | 0.92 ± 0.09 | 0.98 ± 0.19 |

TABLE 15

Relative serum F12 protein levels in C57/B6 mice following administration of 0.5 mg/kg modified F12 RNAi triggers with 2 mg/kg MLP delivery polymer. mF12 levels were normalized to pre-treatment and saline control.

| Treatment | Day 4 | Day 8 | Day 15 | Day 22 | Day 29 | Day 36 | Day 43 |
|---|---|---|---|---|---|---|---|
| Saline | 1.00 ± 0.15 | 1.00 ± 0.13 | 1.00 ± 0.07 | 1.00 ± 0.11 | 1.00 ± 0.10 | 1.00 ± 0.08 | 1.00 ± 0.15 |
| AD01000 | 0.24 ± 0.11 | 0.29 ± 0.18 | 0.50 ± 0.20 | 0.68 ± 0.18 | 0.95 ± 0.13 | 0.89 ± 0.06 | 0.97 ± 0.09 |
| AD01003 | 0.19 ± 0.04 | 0.25 ± 0.09 | 0.43 ± 0.13 | 0.64 ± 0.11 | 0.86 ± 0.03 | 0.86 ± 0.06 | 1.00 ± 0.12 |
| AD01109 | 0.24 ± 0.06 | 0.31 ± 0.16 | 0.74 ± 0.15 | 0.79 ± 0.09 | 0.86 ± 0.12 | 0.87 ± 0.05 | 0.92 ± 0.14 |
| AD01110 | 0.26 ± 0.03 | 0.34 ± 0.07 | 0.78 ± 0.01 | 0.80 ± 0.06 | 0.94 ± 0.04 | 0.85 ± 0.09 | 0.82 ± 0.09 |
| AD01113 | 0.29 ± 0.10 | 0.30 ± 0.04 | 0.71 ± 0.05 | 0.88 ± 0.11 | 1.02 ± 0.08 | 1.02 ± 0.09 | 0.94 ± 0.08 |
| AD01114 | 0.64 ± 0.25 | 0.91 ± 0.32 | 1.05 ± 0.15 | 1.02 ± 0.08 | 0.85 ± 0.06 | 0.89 ± 0.12 | 0.94 ± 0.04 |

TABLE 16

Relative serum F12 protein levels in C57/B6 mice following administration of 0.5 mg/kg modified F12 RNAi triggers with 2 mg/kg MLP delivery polymer. mF12 levels were normalized to pre-treatment and saline control.

| | Day | | | | | | | | |
|---|---|---|---|---|---|---|---|---|---|
| treatment | 4 | 8 | 15 | 22 | 29 | 36 | 43 | 50 | 57 |
| Saline | 1.00 ± 0.13 | 1.00 ± 0.10 | 1.00 ± 0.07 | 1.00 ± 0.08 | 1.00 ± 0.04 | 1.00 ± 0.12 | 1.00 ± 0.09 | 1.00 ± 0.11 | 1.00 ± 0.11 |
| AD01001 | 0.12 ± 0.02 | 0.08 ± 0.02 | 0.17 ± 0.05 | 0.36 ± 0.07 | 0.46 ± 0.06 | 0.69 ± 0.15 | 0.83 ± 0.15 | 0.89 ± 0.11 | 1.05 ± 0.28 |
| AD01126 | 0.34 ± 0.16 | 0.39 ± 0.16 | 0.60 ± 0.17 | 0.88 ± 0.04 | 0.87 ± 0.22 | 0.95 ± 0.10 | 0.94 ± 0.09 | 0.95 ± 0.11 | 1.00 ± 0.08 |
| AD01181 | 0.16 ± 0.03 | 0.15 ± 0.03 | 0.29 ± 0.09 | 0.51 ± 0.09 | 0.69 ± 0.08 | 0.69 ± 0.08 | 0.90 ± 0.10 | 0.87 ± 0.15 | 0.97 ± 0.14 |
| AD01007 | 0.19 ± 0.02 | 0.16 ± 0.04 | 0.30 ± 0.07 | 0.49 ± 0.11 | 0.64 ± 0.07 | 0.77 ± 0.07 | 0.87 ± 0.15 | 0.92 ± 0.04 | 0.88 ± 0.11 |
| AD01118 | 0.22 ± 0.07 | 0.18 ± 0.09 | 0.37 ± 0.16 | 0.52 ± 0.19 | 0.69 ± 0.17 | 0.76 ± 0.16 | 0.90 ± 0.10 | 0.96 ± 0.11 | 0.94 ± 0.18 |
| AD01182 | 0.19 ± 0.04 | 0.17 ± 0.07 | 0.31 ± 0.10 | 0.50 ± 0.15 | 0.67 ± 0.15 | 0.86 ± 0.16 | 0.85 ± 0.18 | 0.92 ± 0.09 | 0.90 ± 0.13 |

Example 6

Figure 2:
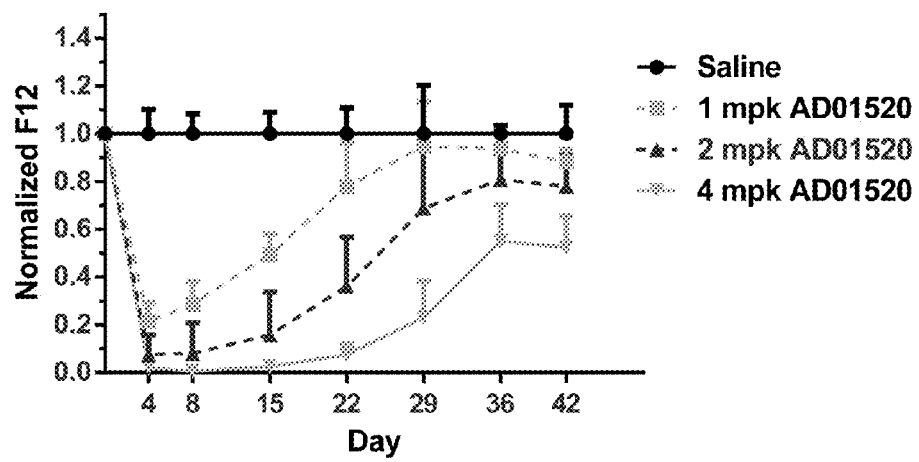
FIG. 2. Graph showing serum F12 protein levels in wild-type mice following administration of 1, 2, or 4 mg/kg F12 RNAi trigger dosed 1:1 wt./wt. with MLP delivery polymer. mF12 levels were normalized to day 1 and saline control.
Figure 3:
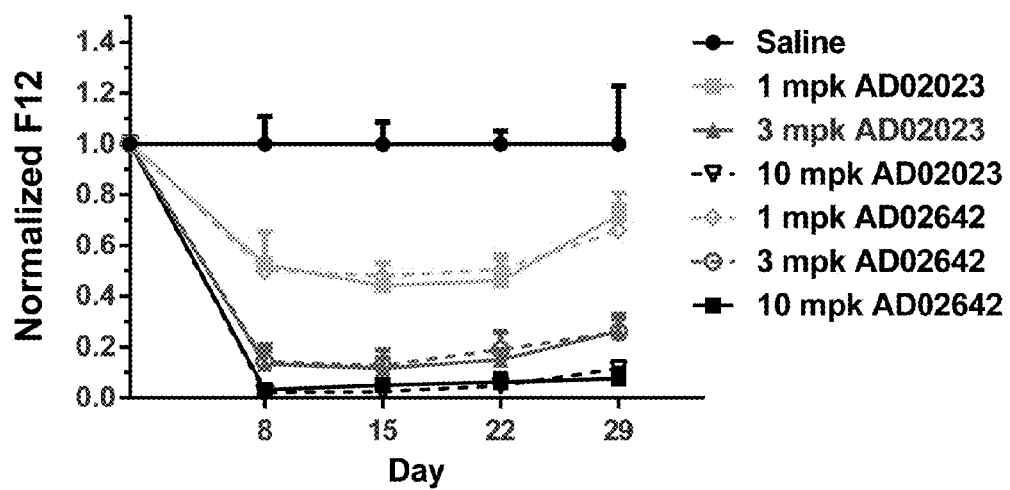
FIG. 3. Graph showing serum F12 protein levels in wild-type mice following a single subcutaneous (SQ) administration of 1, 3, or 10 mg/kg RNAi trigger on day 1. mF12 levels were normalized to day 1 and saline control.

In Vivo Dose Response of Select F12 RNAi Triggers and Time Course of F12 Knockdown To further characterize in vivo activity of select RNAi triggers, activity of multiple dose levels were examined in a single experiment. For studies with MLP delivery polymer (IV), both the amount of RNAi trigger dosed and the amount of delivery polymer was adjusted, so that the dose ratio varied. Dosing and mF12 levels were monitored as described above. Relative serum mF12 levels following administration of RNAi triggers over the time of the experiment is shown (see Tables 17 and 18, FIGS. 2 and 3).

Example 7

Figure 4:
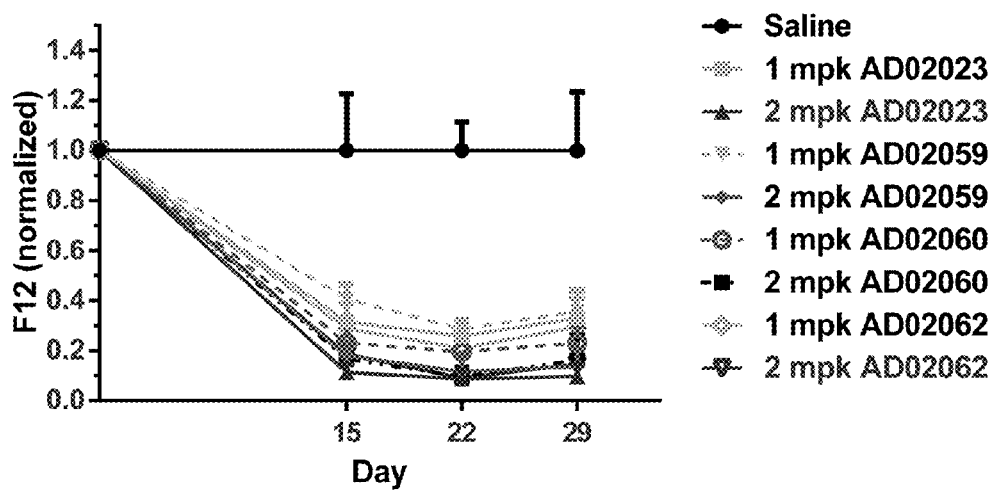
FIG. 4. Graph showing serum F12 protein levels in wild-type mice following SQ administration of 1 or 2 mg/kg RNAi trigger on days 1, 8 and 15. mF12 levels were normalized to day 1 and saline control.

In Vivo Multiple Dose Studies of Select F12 RNAi Triggers and Time Course of F12 Knockdown Select triggers were chosen to examine using multiple dose dosing schemes. The most commonly used dosing scheme was three weekly doses and monitoring mF12 levels as described above. This multiple dose dosing scheme was used most often for SQ-delivered triggers. Relative serum mF12 levels following administration of RNAi triggers over time is shown in FIG. 4.

Example 8

Liver F12 mRNA Levels

At the time of euthanization, part or all of the mouse liver was transferred to an appropriate volume of TRI Reagent RT (Molecular Research Center, Inc., Cincinnati, Ohio). Total RNA was isolated following the manufacturer's recommended protocol. Briefly, liver sections in TRI Reagent RT were treated with a tissue homogenizer for approximately 30 sec. 1 mL homogenate was added to 50 µL of 4-bromoanisole, mixed, and phases were separated by centrifugation. 0.25-0.5 mL of aqueous phase was removed, precipitated with isopropyl alcohol, and centrifuged. The resultant pellet was washed with 75% ethanol and suspended in 0.3-0.7 mL nuclease-free water.

Total RNA (~500 ng) was reverse transcribed using the High Capacity cDNA Reverse Transcription Kit (Life Technologies, Grand Island, N.Y.). The cDNA was then diluted 1:5 and multiplex RT-qPCR was performed using 5' exonuclease chemistry with the commercially available FAM-labeled assay for mouse Factor 12 (Assay ID#Mm00491349_ml, Life Technologies), the VIC-labeled endogenous control assay for mouse beta-actin (Life Technologies) and VeriQuest Master Mix (Affymetrix, Santa Clara, Calif.). Gene expression data were analyzed using the

TABLE 17

Serum F12 protein levels in C57/B6 mice following administration of 0.5, 1, or 2 mg/kg UNA-containing RNAi triggers with 2 mg/kg MLP delivery polymer. mF12 levels were normalized to pre-treatment and saline control

| Treatment | [trigger] (mg/kg) | Day 4 | Day 8 | Day 15 | Day 22 | Day 29 | Day 36 | Day 43 | Day 50 | Day 57 |
|---|---|---|---|---|---|---|---|---|---|---|
| Saline |  | 1.00 ± 0.25 | 1.00 ± 0.28 | 1.00 ± 0.13 | 1.00 ± 0.39 | 1.00 ± 0.19 | 1.00 ± 0.12 | 1.00 ± 0.31 | 1.00 ± 0.16 | 1.00 ± 0.15 |
| AD01000 | 2 | 0.14 ± 0.01 | 0.06 ± 0.04 | 0.19 ± 0.07 | 0.67 ± 0.27 | 0.72 ± 0.17 | 0.81 ± 0.13 | 1.16 ± 0.16 |  |  |
|  | 1 | 0.18 ± 0.03 | 0.13 ± 0.08 | 0.29 ± 0.11 | 0.74 ± 0.30 | 0.81 ± 0.05 | 0.86 ± 0.15 | 1.30 ± 0.13 |  |  |
|  | 0.5 | 0.21 ± 0.06 | 0.17 ± 0.08 | 0.38 ± 0.15 | 0.90 ± 0.10 | 0.89 ± 0.13 | 0.81 ± 0.10 | 1.12 ± 0.24 |  |  |
| AD01001 | 2 | 0.13 ± 0.03 | 0.03 ± 0.01 | 0.03 ± 0.01 | 0.22 ± 0.11 | 0.29 ± 0.10 | 0.52 ± 0.12 | 0.80 ± 0.17 | 0.75 ± 0.26 | 0.93 ± 0.08 |
|  | 1 | 0.15 ± 0.01 | 0.06 ± 0.03 | 0.05 ± 0.02 | 0.40 ± 0.12 | 0.54 ± 0.15 | 0.65 ± 0.13 | 1.00 ± 0.21 | 0.90 ± 0.17 | 0.93 ± 0.14 |
|  | 0.5 | 0.18 ± 0.03 | 0.13 ± 0.06 | 0.24 ± 0.10 | 0.55 ± 0.19 | 0.57 ± 0.12 | 0.72 ± 0.08 | 1.02 ± 0.23 | 0.93 ± 0.16 | 0.94 ± 0.07 |
| AD01003 | 2 | 0.18 ± 0.03 | 0.06 ± 0.02 | 0.19 ± 0.04 | 0.63 ± 0.13 | 0.80 ± 0.15 | 0.84 ± 0.17 | 1.05 ± 0.30 |  |  |
|  | 1 | 0.21 ± 0.03 | 0.10 ± 0.01 | 0.28 ± 0.06 | 0.87 ± 0.15 | 0.78 ± 0.13 | 0.95 ± 0.08 | 1.34 ± 0.19 |  |  |
|  | 0.5 | 0.29 ± 0.10 | 0.19 ± 0.12 | 0.42 ± 0.21 | 1.12 ± 0.33 | 1.11 ± 0.46 | 0.99 ± 0.27 | 1.34 ± 0.33 |  |  |

TABLE 18

Relative serum F12 protein levels in mice following administration of 2 or 4 mg/kg dose of AD01001 RNAi triggers with 1, 2, 4 or 8 mg/kg of MLP delivery polymer. F12 levels were normalized to pre-treatment and saline control.

| treatment | trigger mg/kg | MLP mg/kg | Day 4 | Day 8 | Day 15 | Day 22 | Day 29 | Day 36 | Day 43 | Day 50 | Day 57 |
|---|---|---|---|---|---|---|---|---|---|---|---|
| Saline |  |  | 1.00 ± 0.03 | 1.00 ± 0.05 | 1.00 ± 0.03 | 1.00 ± 0.01 | 1.00 ± 0.06 | 1.00 ± 0.19 | 1.00 ± 0.06 | 1.00 ± 0.19 | 1.00 ± 0.06 |
| AD01001 | 4 | 8 | 0.07 ± 0.01 | 0.01 ± 0.00 | 0.01 ± 0.00 | 0.03 ± 0.01 | 0.06 ± 0.02 | 0.18 ± 0.05 | 0.32 ± 0.08 | 0.54 ± 0.06 | 0.78 ± 0.12 |
|  | 4 | 4 | 0.08 ± 0.05 | 0.05 ± 0.06 | 0.09 ± 0.14 | 0.15 ± 0.20 | 0.24 ± 0.22 | 0.36 ± 0.25 | 0.52 ± 0.19 | 0.75 ± 0.14 | 0.73 ± 0.09 |
|  | 4 | 2 | 0.09 ± 0.02 | 0.08 ± 0.03 | 0.16 ± 0.08 | 0.28 ± 0.12 | 0.42 ± 0.14 | 0.65 ± 0.18 | 0.69 ± 0.09 | 0.79 ± 0.19 | 0.79 ± 0.06 |
|  | 2 | 4 | 0.06 ± 0.01 | 0.04 ± 0.01 | 0.05 ± 0.03 | 0.11 ± 0.06 | 0.23 ± 0.10 | 0.38 ± 0.12 | 0.54 ± 0.16 | 0.76 ± 0.11 | 0.74 ± 0.04 |
|  | 2 | 2 | 0.10 ± 0.02 | 0.07 ± 0.02 | 0.12 ± 0.05 | 0.24 ± 0.06 | 0.39 ± 0.10 | 0.58 ± 0.11 | 0.75 ± 0.08 | 0.85 ± 0.11 | 0.79 ± 0.07 |
|  | 2 | 1 | 0.27 ± 0.13 | 0.35 ± 0.16 | 0.41 ± 0.03 | 0.72 ± 0.17 | 0.75 ± 0.12 | 0.93 ± 0.13 | 0.93 ± 0.16 | 0.74 ± 0.13 | 0.79 ± 0.13 | comparative CT method of relative quantification (Livak and Schmittgen, 2001) (Tables 19 and 20).

TABLE 19

Relative serum F12 protein levels in mice following administration of canonical or UNA-containing RNAi trigger 1:1 with MLP delivery polymer. Serum F12 levels were normalized to day 1 and saline control.

| Treatment | Day −1 | Day 8 |
|---|---|---|
| Saline | 1.00 ± 0.00 | 1.00 ± 0.38 |
| AD00900 | 1.00 ± 0.00 | 0.01 ± 0.00 |
| AD01000 | 1.00 ± 0.00 | 0.01 ± 0.00 |
| AD01001 | 1.00 ± 0.00 | 0.01 ± 0.00 |
| AD01003 | 1.00 ± 0.00 | 0.02 ± 0.01 |

TABLE 20

Liver mF12 mRNA levels in mice following administration of canonical or UNA-containing RNAi trigger 1:1 wt./wt. with MLP delivery polymer. F12 mRNA level is expressed relative to mouse β-actin mRNA level.

| Treatment | Relative Expression day 8 | Low error | High error |
|---|---|---|---|
| Saline | 1.00 | −0.09 | +0.09 |
| AD00900 | 0.05 | −0.01 | +0.01 |
| AD01000 | 0.04 | −0.00 | +0.01 |
| AD01001 | 0.03 | −0.00 | +0.00 |
| AD01003 | 0.05 | −0.00 | +0.00 |
| AD01520 | 2 | 0.07 | 0.01 |

Example 9

Figure 9:
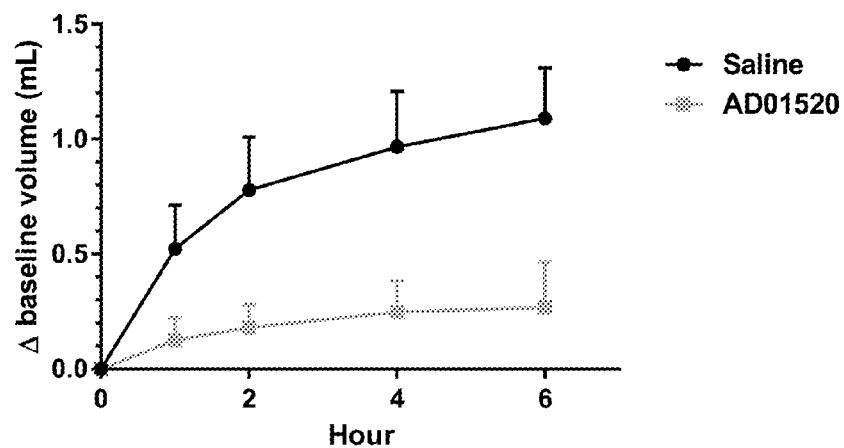
FIG. 9. Graph showing change in rat paw volume after carrageenan injection in rats treated seven days prior to carrageenan injection with either saline, or 8 mg/kg F12 RNAi trigger AD01520 with 8 mg/kg MLP delivery polymer. A. Shows change in paw volume in treated vs. saline animals. B. Shows level of knockdown in treated vs. saline animals.
Figure 9:
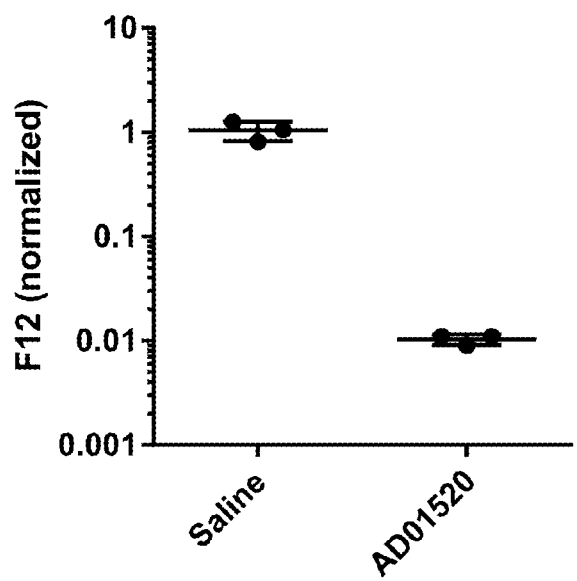

Examination of Pharmacodynamic (PD) Effects of F12 Reduction after Treatment with F12 RNAi Triggers-Carrageenan Induced Paw Edema (CPE) in Rats To test that reducing F12 levels leads to effects on the kallikrein/kinin system, we tested the effects of pre-treatment with F12 RNAi triggers on an inflammation model (CPE) in rats. Inflammation induced by λ carrageenan is induced by multiple mediators including bradykinin. Wild-type rats were given a single IV dose of either 8 mg/kg RNAi trigger (AD01520) with 8 mg/kg MLP delivery polymer, or saline. After 7 days, carrageenan was injected into the rear paws of saline or RNAi trigger-treated rats, and paw volume was measured over 6 hours. Change in paw volume over time is plotted in FIG. 9. The difference in paw volume changes between saline and F12 RNAi trigger-treated groups are statistically significant (p<0.0001), and are similar to those seen with treatment of kallikrein-targeted antibody (Kenniston J A et al 2014), indicating a reduction of signaling through the kallikrein/kinin system.

Example 10

Figure 10:
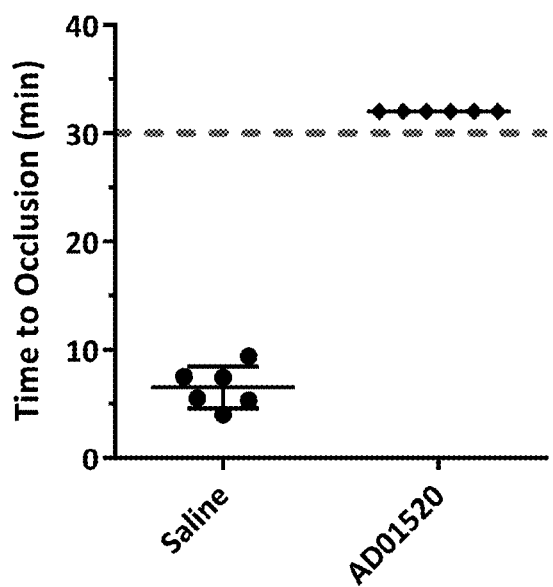
FIG. 10. Graph showing: A. Time to occlusion after ferric chloride challenge in mice treated seven days prior to ferric chloride challenge with either saline, or 8 mg/kg F12 RNAi trigger AD01520 with 8 mg/kg MLP delivery polymer. All animals in the RNAi trigger-treated group did not occlude during the time of the experiment (30 minutes, noted by dashed line). B. Knockdown in animals treated with F12 RNAi trigger AD01520 with MLP delivery polymer, compared to animals treated with saline.
Figure 10:
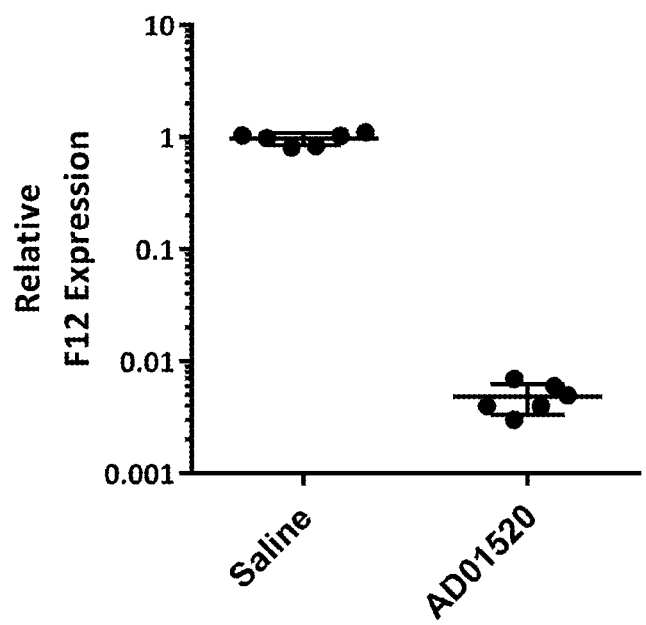

Examination of Pharmacodynamic (PD) Effects of F12 Reduction after Treatment with F12 RNAi Triggers—Ferric Chloride Challenge A clinically relevant indicator of physiologic response to F12 knockdown is the thromboembolism model induced by Ferric Chloride treatment. Cholesterol-conjugated canonical RNAi triggers were administered to wild-type mice as described above 7 days prior to Ferric Chloride (FeCl3) Challenge. Prior to FeCl3 challenge, F12 levels were measured. Treatment with 4 mg/kg AD01520 and 4 mg/kg MLP delivery polymer resulted in >99% knockdown of mF12 protein in the serum. Thrombosis is induced by exposure of the carotid artery (CA) to ferric chloride and time to occlusion of blood flow is measured by flow probe for up to 30 minutes. All mice treated with F12 RNAi trigger with MLP delivery polymer did not occlude during the timeframe of the experiment (FIG. 10).

Example 11

Examination of Pharmacodynamic (PD) Effects of F12 Reduction after Treatment with F12 RNAi Triggers—Bleeding Risk A potential risk of some anticoagulant treatments is an increased risk of bleeding events. A Factor VII (F7)-targeted RNAi trigger was used as a positive bleeding control, as F7 is known as a key component of the extrinsic coagulation pathway.

Figure 11:
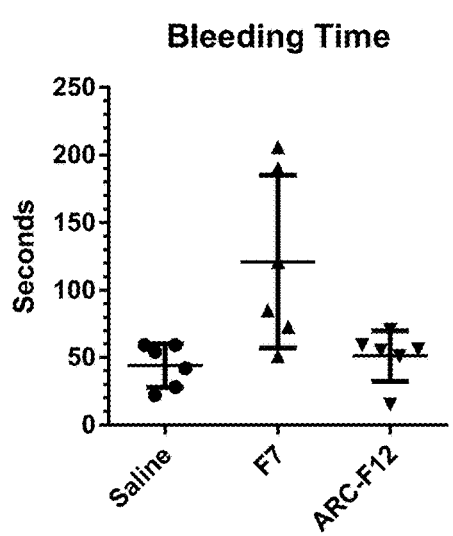
FIG. 11. Graphs showing: A. Bleeding times of mice treated with either saline, 8 mg/kg F7-targeted RNAi trigger with 8 mg/kg MLP delivery polymer, or 8 mg/kg F12 RNAi trigger AD01520 with 8 mg/kg MLP delivery polymer. B. F12 protein levels. C. F7 protein levels.
Figure 11:
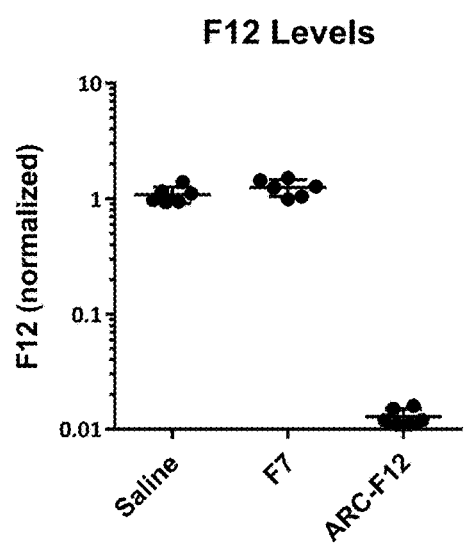
Figure 11:
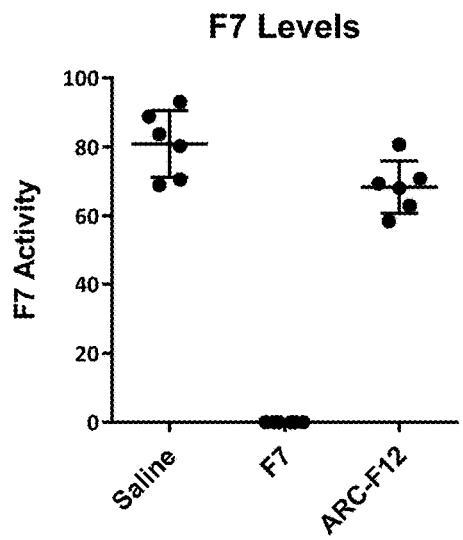

Wild-type mice were given a single IV dose of 8 mg/kg AD01520 with 8 mg/kg MLP delivery polymer, or 8 mg/kg F7 trigger with 8 mg/kg MLP delivery polymer 7 days prior to challenge. Transverse cut of the tail vein was performed, and time to clotting monitored up to 15 minutes. There was no significant difference in bleeding times between saline and AD01520 treated mice (FIG. 11).

Example 12

Factor 12 (F12) Knockdown in Non-Human Primates Following F12 RNAi Trigger Molecule Delivery with MLP Delivery Polymer MLP delivery polymer and RNAi trigger were made and combined in a pharmaceutically acceptable buffer as described above. On day 1, two cynomolgus macaque (*Macaca fascicularis*) primates (both male, 5.0 kg and 8.15 kg, respectively) were co-injected with 2 mg/kg RNAi trigger (AD01001) and 2 mg/kg MLP delivery polymer. For each injection, the RNAi trigger+MLP delivery polymer (2 mg/kg) was injected into the saphenous vein using a 22 to 25 gauge intravenous catheter. At the indicated time points (indicated in Tables 21-23), blood samples were drawn and analyzed for F12 levels, coagulation parameters and toxicity markers. Blood was collected from the femoral vein and primates were fasted overnight before all blood collections. Blood tests for blood urea nitrogen (BUN), alanine transaminase (ALT), aspartate aminotransferase (AST), creatinine, and activated Partial thromboplastin time (aPTT) were performed on an automated chemistry analyzer. F12 protein levels in serum were monitored by assaying serum from the monkeys using an ELISA for human F12 (Molecular Innovations) until F12 expression levels returned to baseline. For normalization, F12 levels for each animal at a respective time point was divided by the pre-treatment level of expression in that animal (in this case at day 1) to determine the ratio of expression "normalized to day 1". Functional readout of F12 knockdown can also be observed through elongation of the activated partial thromboplastin time (aPTT). No changes in Prothrombin time were observed with treatment.

Significant knockdown of F12 was observed with an average maximum knockdown of 92.5% observed at day 15. An increase in aPTT was observed in both animals with maximal increases over pre-bleed values between 50-56% at days 15 and 22, although aPTT did not exceed "normal" values. No dose-related toxicity was observed in treated animals.

were fasted overnight before all blood collections. Blood tests for blood urea nitrogen (BUN), alanine transaminase (ALT), aspartate aminotransferase (AST), creatinine, and

TABLE 21

Serum F12 protein levels in cynomolgus macaque (*Macaca fascicularis*) primates following administration of 2 mg/kg AD01001 with 2 mg/kg MLP delivery polymer. mF12 levels were normalized to pre-dose.

| animal | pre-dose | Day | | | | | | | | | | | | |
|---|---|---|---|---|---|---|---|---|---|---|---|---|---|---|
| | | 3 | 8 | 15 | 22 | 29 | 36 | 43 | 50 | 57 | 64 | 71 | 78 | 85 |
| 1 | 1.00 | 0.59 | 0.13 | 0.09 | 0.13 | 0.20 | 0.44 | 0.60 | 0.58 | 0.68 | 1.50 | 1.46 | 1.59 | 1.63 |
| 2 | 1.00 | 0.42 | 0.14 | 0.06 | 0.08 | 0.11 | 0.22 | 0.25 | 0.42 | 0.51 | 0.70 | 0.76 | 0.91 | 1.01 |

TABLE 22

Activated Partial Thromboplastin Time (sec) in cynomolgus macaque (*Macaca fascicularis*) primates following administration of 2 mg/kg AD01001 with 2 mg/kg MLP delivery polymer.

| animal | pre-dose | Day | | | | | | | |
|---|---|---|---|---|---|---|---|---|---|
| | | 3 | 8 | 15 | 22 | 29 | 36 | 43 | 50 | 57 |
| 1 | 32.2 | 35.4 | 44.9 | 48.6 | 47.5 | 39.9 | 42.9 | 34.3 | 38.3. | 27 |
| 2 | 29.6 | 25.0 | 32.0 | 42.2 | 46.3 | 47.4 | 42.5 | 45.0 | 38.1 | 29.4 |

TABLE 23

Urea Nitrogen, Creatinine, Alanine transaminase, and Aspartate aminotransferase levels in cynomolgus macaque (*Macaca fascicularis*) primates following administration of 2 mg/kg AD01001 with 2 mg/kg MLP delivery polymer.

| animal | pre-dose | day | | | | | | | |
|---|---|---|---|---|---|---|---|---|---|
| | | 3 | 8 | 15 | 22 | 29 | 36 | 43 | 50 | 57 |
| Blood Urea Nitrogen (mg/dL) | | | | | | | | | | |
| 1 | 13 | 13 | 12 | 13 | 14 | 13 | 13 | 14 | 14 | 14 |
| 2 | 18 | 17 | 15 | 17 | 16 | 14 | 18 | 17 | 19 | 18 |
| Creatinine (mg/dL) | | | | | | | | | | |
| 1 | 0.76 | 0.69 | 0.76 | 0.79 | 0.78 | 0.77 | 0.77 | 0.75 | 0.69 | 0.78 |
| 2 | 1.03 | 1.05 | 0.04 | 0.99 | 0.98 | 1.00 | 1.08 | 1.02 | 1.03 | 1.01 |
| Alanine transaminase (U/L) | | | | | | | | | | |
| 1 | 45 | 45 | 44 | 43 | 42 | 45 | 45 | 44 | 42 | 41 |
| 2 | 40 | 44 | 45 | 41 | 38 | 47 | 54 | 50 | 49 | 52 |
| Aspartate aminotransferase (U/L) | | | | | | | | | | |
| 1 | 24 | 27 | 22 | 24 | 28 | 24 | 21 | 31 | 27 | 22 |
| 2 | 25 | 23 | 23 | 22 | 30 | 22 | 21 | 21 | 24 | 22 |

Example 13

Factor 12 (F12) Knockdown in Non-Human Primates Following F12 RNAi Trigger Molecule Delivery MLP delivery polymer and RNAi trigger were made and combined in a pharmaceutically acceptable buffer as described above. On day 1, two cynomolgus macaque (*Macaca fascicularis*) primates were co-injected with either 2 mg/kg AD01001 and 2 mg/kg MLP delivery polymer, or 2 mg/kg AD01520 and 2 mg/kg MLP delivery polymer as described above. Blood samples were drawn and analyzed for F12 levels, coagulation parameters and toxicity markers. Blood was collected from the femoral vein and primates activated Partial thromboplastin time (aPTT) were performed on an automated chemistry analyzer. F12 protein levels in serum were monitored by assaying serum from the monkeys using an ELISA for human F12 (Molecular Innovations) until F12 expression levels returned to baseline. For normalization, F12 levels for each animal at a respective time point was divided by the pre-treatment level of expression in that animal (in this case at day 1) to determine the ratio of expression "normalized to day 1". Functional readout of F12 knockdown can also be observed through elongation of the activated partial thromboplastin time (aPTT). No changes in prothrombin time (PT) were observed with treatment.

Significant knockdown of F12 was observed with an average maximum knockdown of 89% observed at day 15

Figure 5:
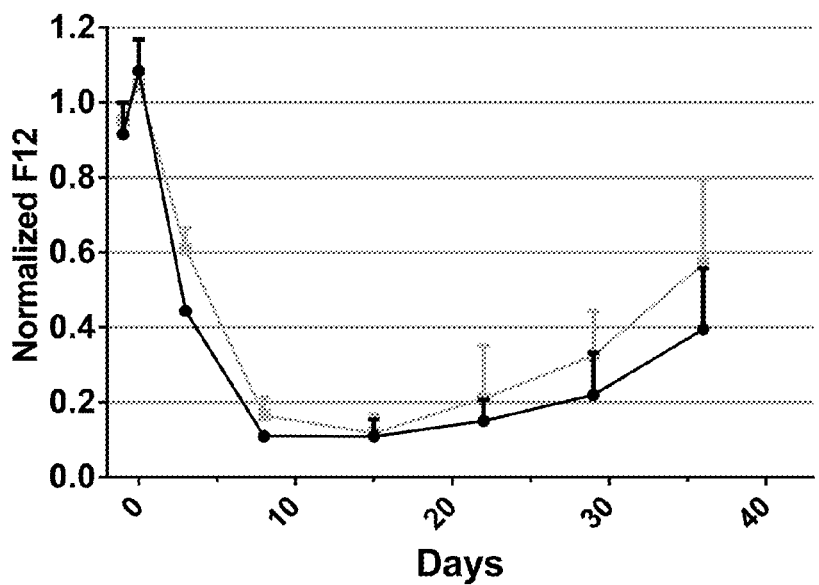
FIG. 5. Graph showing serum F12 protein levels in cynomolgus monkeys following administration of a single 2 mg/kg RNAi trigger dosed 1:1 wt./wt. with MLP delivery polymer on day 1. cF12 levels were normalized to day 1. F12 RNAi trigger AD01001 is shown in black circles, F12 RNAi trigger AD01520 is shown in gray squares. Standard Deviation is displayed as error bars graphed above the mean.

(FIG. 5). An increase in aPTT was observed in both animals with maximal increases over pre-bleed values of approximately 70%-80% at days 15 and 22, although aPTT did not exceed "normal" values. No dose-related toxicity was observed in treated animals.

Example 14

Factor 12 (F12) Knockdown in Non-Human Primates Following F12 RNAi Trigger Molecule Delivery MLP delivery polymer and RNAi trigger were made and combined in a pharmaceutically acceptable buffer as described above. On days 1, 29, 57, 85, two cynomolgus macaque (*Macaca fascicularis*) primates were co-injected with either 2 mg/kg AD01001 and 2 mg/kg MLP delivery polymer, or 2 mg/kg AD01520 and 2 mg/kg MLP delivery polymer as described above. Blood samples were drawn and analyzed for F12 levels, coagulation parameters and toxicity markers. Blood was collected from the femoral vein and primates were fasted overnight before all blood collections. Blood tests for blood urea nitrogen (BUN), alanine transaminase (ALT), aspartate aminotransferase (AST), creatinine, and both prothrombin time (PT) and activated Partial thromboplastin time (aPTT) were performed on an automated chemistry analyzer. F12 protein levels in serum were monitored by assaying serum from the monkeys using an ELISA for human F12 (Molecular Innovations) until F12 expression levels returned to baseline. For normalization, F12 levels for each animal at a respective time point was divided by the pre-treatment level of expression in that animal (in this case at day 1) to determine the ratio of expression "normalized to day 1". Functional readout of F12 knockdown can also be observed through elongation of the activated partial thromboplastin time (aPTT). No changes in Prothrombin time were observed with treatment.

Figure 6:
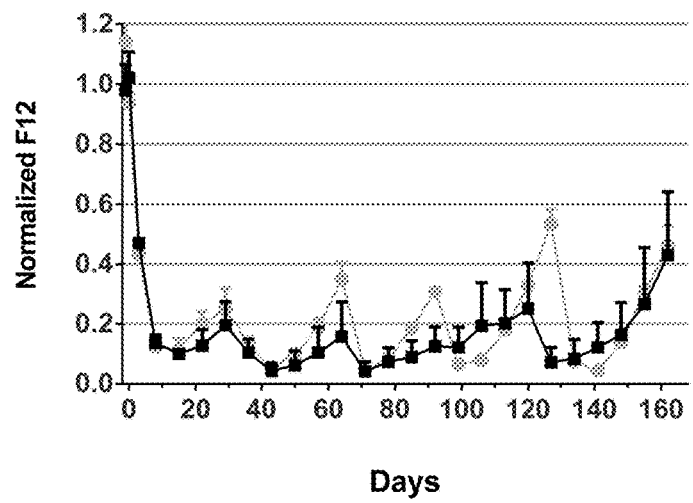
FIG. 6. Graph showing serum F12 protein levels in cynomolgus monkeys following administration of 2 mg/kg RNAi trigger dosed 1:1 with MLP delivery polymer on day 1, 29, 57, and 85. cF12 levels were normalized to day 1. F12 RNAi trigger AD01001 is shown in black circles, F12 RNAi trigger AD01520 is shown in gray squares. Standard deviation is displayed as error bars graphed above the mean.
Figure 7:
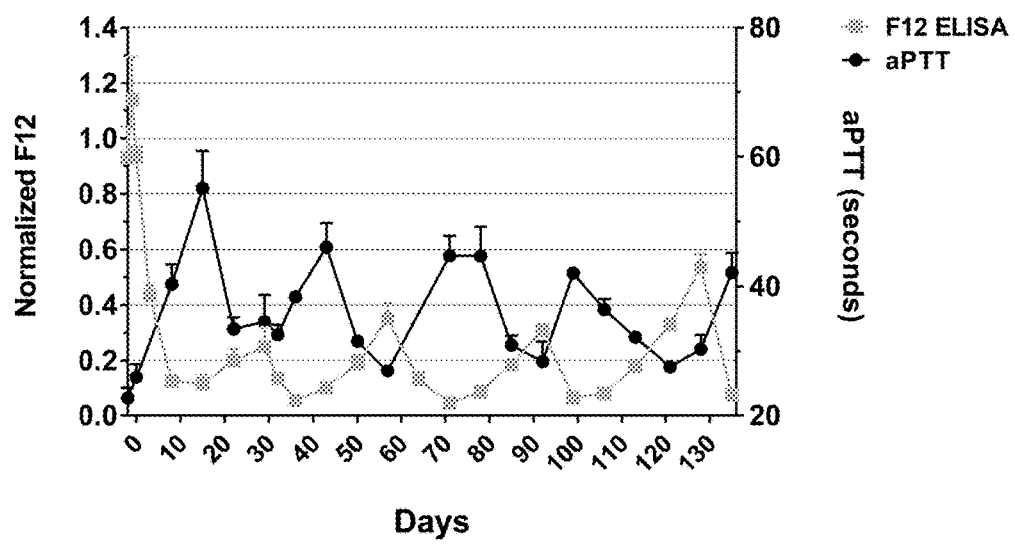
FIG. 7. Graph showing serum F12 protein levels in cynomolgus monkeys following administration of 4 mg/kg F12 RNAi trigger AD01520 dosed 1:1 with MLP delivery polymer on day 1, 29, 57, 85, and 121. cF12 levels were normalized to day 1. cF12 levels are graphed in gray squares, aPTT is shown in black circles. Standard deviation is displayed as error bars graphed above the mean.

Significant knockdown of F12 was observed with an average maximum knockdown between 85-93% observed at day 15, and between 95-98% on subsequent doses (FIG. 6). An increase in aPTT was observed in both animals with maximal increases over pre-bleed values observed when F12 levels are at nadir (FIG. 7). No dose-related toxicity nor increase in PT was observed in treated animals over the time of the experiment.

Example 15

Factor 12 (F12) Knockdown in Non-Human Primates Following F12 RNAi Trigger Molecule Delivery RNAi trigger was made and combined in a pharmaceutically acceptable buffer as described above for subcutaneous (SQ) injection. On day 1, two cynomolgus macaque (*Macaca fascicularis*) primates were injected with either 3 mg/kg AD02562, or 10 mg/kg AD02562 subcutaneously. Blood samples were drawn and analyzed for F12 levels, coagulation parameters and toxicity markers as previously described.

Figure 8:
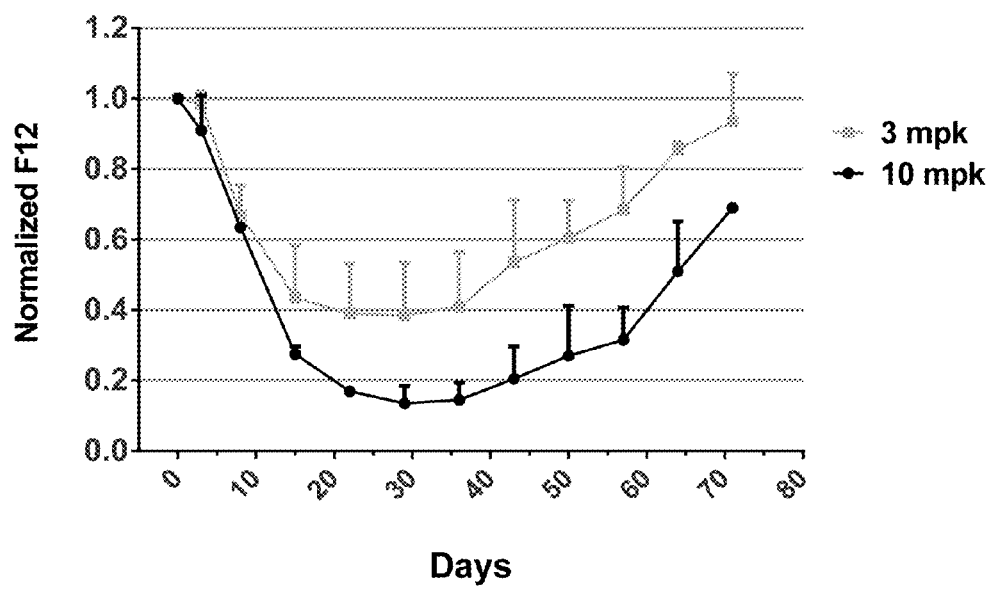
FIG. 8. Graph showing serum F12 protein levels in cynomolgus monkeys following single subcutaneous administration of 3 mg/kg or 10 mpg of F12 RNAi trigger AD02562 on day 1. cF12 levels were normalized to day 1.3 mg/kg dose is shown in gray squares, 10 mg/kg dose is shown in black circles. Standard deviation is displayed as error bars graphed above the mean.

Knockdown of F12 was observed with an average maximum knockdown of 60% for the 3 mg/kg dose and 84% for the 10 mg/kg dose, observed between days 22 and day 29 (FIG. 8). No dose-related toxicity nor increase in PT was observed in treated animals over the duration of the experiment.

Example 16

Examples of F12 RNAi Trigger Duplexes

TABLE 24

F12 RNAi triggers identified by Duplex ID No. with corresponding sense and antisense strands.

| Duplex ID | Antisense Strand ID | Sense Strand ID | Duplex ID | Antisense Strand ID | Sense Strand ID |
|---|---|---|---|---|---|
| AD00638 | AM01377-AS | AM01307-SS | AD00873 | AM01556-AS | AM01513-SS |
| AD00639 | AM01378-AS | AM01308-SS | AD01227 | AM02060-AS | AM02061-SS |
| AD00640 | AM01379-AS | AM01309-SS | AD01228 | AM02062-AS | AM02063-SS |
| AD00641 | AM01380-AS | AM01310-SS | AD01269 | AM02112-AS | AM00923-SS |
| AD00642 | AM01381-AS | AM01311-SS | AD01270 | AM02113-AS | AM00923-SS |
| AD00643 | AM01382-AS | AM01312-SS | AD01302 | AM02164-AS | AM02168-SS |
| AD00644 | AM01383-AS | AM01313-SS | AD01304 | AM02166-AS | AM02168-SS |
| AD00645 | AM01384-AS | AM01314-SS | AD01305 | AM02167-AS | AM02168-SS |
| AD00646 | AM01385-AS | AM01315-SS | AD01306 | AM02164-AS | AM02169-SS |
| AD00647 | AM01386-AS | AM01316-SS | AD01308 | AM02166-AS | AM02169-SS |
| AD00648 | AM01387-AS | AM01317-SS | AD01309 | AM02167-AS | AM02169-SS |
| AD00649 | AM01388-AS | AM01318-SS | AD01480 | AM02165-AS | AM02459-SS |
| AD00650 | AM01389-AS | AM01319-SS | AD01481 | AM02460-AS | AM02459-SS |
| AD00651 | AM01390-AS | AM01320-SS | AD01482 | AM02461-AS | AM02459-SS |
| AD00652 | AM01391-AS | AM01321-SS | AD01483 | AM02462-AS | AM02459-SS |
| AD00653 | AM01392-AS | AM01322-SS | AD01551 | AM02579-AS | AM02581-SS |
| AD00654 | AM01393-AS | AM01323-SS | AD01552 | AM02582-AS | AM02584-SS |
| AD00655 | AM01394-AS | AM01324-SS | AD01553 | AM02585-AS | AM02274-SS |
| AD00656 | AM01395-AS | AM01325-SS | AD01584 | AM02641-AS | AM01617-SS |
| AD00657 | AM01396-AS | AM01326-SS | AD01585 | AM02642-AS | AM01617-SS |
| AD00658 | AM01397-AS | AM01327-SS | AD01586 | AM02643-AS | AM01617-SS |
| AD00659 | AM01399-AS | AM01328-SS | AD01587 | AM02644-AS | AM01617-SS |
| AD00660 | AM01400-AS | AM01329-SS | AD01588 | AM02645-AS | AM01617-SS |
| AD00661 | AM01401-AS | AM01330-SS | AD01589 | AM02646-AS | AM01617-SS |
| AD00662 | AM01402-AS | AM01331-SS | AD01590 | AM02647-AS | AM01617-SS |
| AD00663 | AM01403-AS | AM01332-SS | AD01591 | AM02648-AS | AM01617-SS |
| AD00664 | AM01404-AS | AM01333-SS | AD01592 | AM02645-AS | AM02649-SS |
| AD00665 | AM01405-AS | AM01334-SS | AD01593 | AM02646-AS | AM02649-SS |
| AD00666 | AM01406-AS | AM01335-SS | AD01594 | AM02647-AS | AM02649-SS |

TABLE 24-continued

F12 RNAi triggers identified by Duplex ID No. with corresponding sense and antisense strands.

| Duplex ID | Antisense Strand ID | Sense Strand ID | Duplex ID | Antisense Strand ID | Sense Strand ID |
|---|---|---|---|---|---|
| AD00667 | AM01407-AS | AM01336-SS | AD01595 | AM02648-AS | AM02649-SS |
| AD00668 | AM01408-AS | AM01337-SS | AD01596 | AM00988-AS | AM02649-SS |
| AD00669 | AM01409-AS | AM01338-SS | AD01597 | AM01629-AS | AM02649-SS |
| AD00670 | AM01410-AS | AM01339-SS | AD01606 | AM02208-AS | AM02654-SS |
| AD00671 | AM01411-AS | AM01340-SS | AD01609 | AM02656-AS | AM02654-SS |
| AD00672 | AM01412-AS | AM01341-SS | AD01625 | AM02660-AS | AM02664-SS |
| AD00673 | AM01413-AS | AM01342-SS | AD01626 | AM02661-AS | AM02664-SS |
| AD00674 | AM01414-AS | AM01343-SS | AD01631 | AM02660-AS | AM02665-SS |
| AD00675 | AM01415-AS | AM01344-SS | AD01632 | AM02661-AS | AM02665-SS |
| AD00676 | AM01416-AS | AM01345-SS | AD01634 | AM02657-AS | AM02666-SS |
| AD00677 | AM01417-AS | AM01346-SS | AD01660 | AM02691-AS | AM02723-SS |
| AD00678 | AM01418-AS | AM01347-SS | AD01661 | AM02692-AS | AM02724-SS |
| AD00679 | AM01419-AS | AM01348-SS | AD01662 | AM02693-AS | AM02725-SS |
| AD00680 | AM01420-AS | AM01349-SS | AD01663 | AM02694-AS | AM02726-SS |
| AD00681 | AM01421-AS | AM01350-SS | AD01664 | AM02695-AS | AM02727-SS |
| AD00682 | AM01422-AS | AM01351-SS | AD01665 | AM02696-AS | AM02728-SS |
| AD00683 | AM01423-AS | AM01352-SS | AD01666 | AM02697-AS | AM02729-SS |
| AD00684 | AM01424-AS | AM01353-SS | AD01667 | AM02698-AS | AM02730-SS |
| AD00685 | AM01425-AS | AM01354-SS | AD01668 | AM02699-AS | AM02731-SS |
| AD00686 | AM01426-AS | AM01355-SS | AD01669 | AM02700-AS | AM02732-SS |
| AD00687 | AM01427-AS | AM01356-SS | AD01670 | AM02701-AS | AM02733-SS |
| AD00688 | AM01428-AS | AM01357-SS | AD01671 | AM02702-AS | AM02734-SS |
| AD00689 | AM01429-AS | AM01358-SS | AD01672 | AM02703-AS | AM02735-SS |
| AD00690 | AM01430-AS | AM01359-SS | AD01673 | AM02704-AS | AM02736-SS |
| AD00691 | AM01431-AS | AM01360-SS | AD01674 | AM02705-AS | AM02737-SS |
| AD00692 | AM01432-AS | AM01361-SS | AD01675 | AM02706-AS | AM02738-SS |
| AD00693 | AM01433-AS | AM01362-SS | AD01676 | AM02707-AS | AM02723-SS |
| AD00694 | AM01434-AS | AM01363-SS | AD01677 | AM02708-AS | AM02724-SS |
| AD00695 | AM01435-AS | AM01364-SS | AD01678 | AM02709-AS | AM02725-SS |
| AD00696 | AM01436-AS | AM01365-SS | AD01679 | AM02710-AS | AM02726-SS |
| AD00697 | AM01437-AS | AM01366-SS | AD01680 | AM02711-AS | AM02727-SS |
| AD00698 | AM01438-AS | AM01367-SS | AD01681 | AM02712-AS | AM02728-SS |
| AD00699 | AM01439-AS | AM01368-SS | AD01682 | AM02713-AS | AM02729-SS |
| AD00700 | AM01440-AS | AM01369-SS | AD01683 | AM02714-AS | AM02730-SS |
| AD00701 | AM01441-AS | AM01370-SS | AD01684 | AM02715-AS | AM02731-SS |
| AD00702 | AM01442-AS | AM01371-SS | AD01685 | AM02716-AS | AM02732-SS |
| AD00703 | AM01443-AS | AM01372-SS | AD01686 | AM02717-AS | AM02733-SS |
| AD00704 | AM01444-AS | AM01373-SS | AD01687 | AM02718-AS | AM02734-SS |
| AD00705 | AM01445-AS | AM01374-SS | AD01688 | AM02719-AS | AM02735-SS |
| AD00706 | AM01446-AS | AM01375-SS | AD01689 | AM02720-AS | AM02736-SS |
| AD00707 | AM01447-AS | AM01376-SS | AD01690 | AM02721-AS | AM02737-SS |
| AD00831 | AM01514-AS | AM01471-SS | AD01691 | AM02722-AS | AM02738-SS |
| AD00832 | AM01515-AS | AM01472-SS | AD01692 | AM02707-AS | AM02739-SS |
| AD00833 | AM01516-AS | AM01473-SS | AD01693 | AM02708-AS | AM02740-SS |
| AD00834 | AM01517-AS | AM01474-SS | AD01694 | AM02709-AS | AM02741-SS |
| AD00835 | AM01518-AS | AM01475-SS | AD01695 | AM02710-AS | AM02742-SS |
| AD00836 | AM01519-AS | AM01476-SS | AD01696 | AM02711-AS | AM02743-SS |
| AD00837 | AM01520-AS | AM01477-SS | AD01697 | AM02712-AS | AM02744-SS |
| AD00838 | AM01521-AS | AM01478-SS | AD01698 | AM02713-AS | AM02745-SS |
| AD00839 | AM01522-AS | AM01479-SS | AD01699 | AM02714-AS | AM02746-SS |
| AD00840 | AM01523-AS | AM01480-SS | AD01700 | AM02715-AS | AM02747-SS |
| AD00841 | AM01524-AS | AM01481-SS | AD01701 | AM02716-AS | AM02748-SS |
| AD00842 | AM01525-AS | AM01482-SS | AD01702 | AM02717-AS | AM02749-SS |
| AD00843 | AM01526-AS | AM01483-SS | AD01703 | AM02718-AS | AM02750-SS |
| AD00844 | AM01527-AS | AM01484-SS | AD01704 | AM02719-AS | AM02751-SS |
| AD00845 | AM01528-AS | AM01485-SS | AD01705 | AM02720-AS | AM02752-SS |
| AD00846 | AM01529-AS | AM01486-SS | AD01706 | AM02721-AS | AM02753-SS |
| AD00847 | AM01530-AS | AM01487-SS | AD01707 | AM02722-AS | AM02754-SS |
| AD00848 | AM01531-AS | AM01488-SS | AD01781 | AM02871-AS | AM02500-SS |
| AD00849 | AM01532-AS | AM01489-SS | AD01782 | AM02871-AS | AM02872-SS |
| AD00850 | AM01533-AS | AM01490-SS | AD01783 | AM02507-AS | AM02872-SS |
| AD00851 | AM01534-AS | AM01491-SS | AD01833 | AM02953-AS | AM02955-SS |
| AD00852 | AM01535-AS | AM01492-SS | AD01906 | AM02656-AS | AM03054-SS |
| AD00853 | AM01536-AS | AM01493-SS | AD01907 | AM02656-AS | AM03055-SS |
| AD00854 | AM01537-AS | AM01494-SS | AD01908 | AM02656-AS | AM03057-SS |
| AD00855 | AM01538-AS | AM01495-SS | AD01909 | AM02847-AS | AM02872-SS |
| AD00856 | AM01539-AS | AM01496-SS | AD01950 | AM02656-AS | AM03044-SS |
| AD00857 | AM01540-AS | AM01497-SS | AD01951 | AM02656-AS | AM03032-SS |
| AD00858 | AM01541-AS | AM01498-SS | AD01952 | AM02656-AS | AM03033-SS |
| AD00859 | AM01542-AS | AM01499-SS | AD01995 | AM02656-AS | AM03138-SS |
| AD00860 | AM01543-AS | AM01500-SS | AD01996 | AM02656-AS | AM03139-SS |
| AD00861 | AM01544-AS | AM01501-SS | AD01997 | AM02656-AS | AM03140-SS |
| AD00862 | AM01545-AS | AM01502-SS | AD01998 | AM02656-AS | AM03141-SS |
| AD00863 | AM01546-AS | AM01503-SS | AD02048 | AM02656-AS | AM03180-SS |

TABLE 24-continued

F12 RNAi triggers identified by Duplex ID No. with corresponding sense and antisense strands.

| Duplex ID | Antisense Strand ID | Sense Strand ID | Duplex ID | Antisense Strand ID | Sense Strand ID |
|---|---|---|---|---|---|
| AD00864 | AM01547-AS | AM01504-SS | AD02631 | AM03157-AS | AM03372-SS |
| AD00865 | AM01548-AS | AM01505-SS | AD02632 | AM03157-AS | AM03373-SS |
| AD00866 | AM01549-AS | AM01506-SS | AD02633 | AM03157-AS | AM03374-SS |
| AD00867 | AM01550-AS | AM01507-SS | AD02641 | AM03157-AS | AM03401-SS |
| AD00868 | AM01551-AS | AM01508-SS | AD02660 | AM03410-AS | AM03421-SS |
| AD00869 | AM01552-AS | AM01509-SS | AD02742 | AM03157-AS | AM03540-SS |
| AD00870 | AM01553-AS | AM01510-SS | AD02743 | AM03157-AS | AM03541-SS |
| AD00871 | AM01554-AS | AM01511-SS | AD02818 | AM03644-AS | AM03436-SS |
| AD00872 | AM01555-AS | AM01512-SS | AD02980 | AM03803-AS | AM03653-SS |
| AD02833 | AM03662-AS | AM03402-SS | AD02981 | AM03804-AS | AM03653-SS |
| AD02834 | AM03663-AS | AM03402-SS | AD02982 | AM03805-AS | AM03653-SS |
| AD02835 | AM03664-AS | AM03402-SS | AD02983 | AM03581-AS | AM03778-SS |
| AD02836 | AM03665-AS | AM03402-SS | AD02984 | AM03787-AS | AM03806-SS |
| AD02837 | AM03666-AS | AM03402-SS | AD02985 | AM03581-AS | AM03807-SS |
| AD02838 | AM03667-AS | AM03402-SS | AD02986 | AM03808-AS | AM03653-SS |
| AD02839 | AM03157-AS | AM03669-SS | AD02987 | AM03808-AS | AM03807-SS |
| AD02840 | AM03668-AS | AM03402-SS | AD02988 | AM03809-AS | AM03726-SS |
| AD02856 | AM03157-AS | AM03684-SS | AD02989 | AM03810-AS | AM03726-SS |
| AD02867 | AM03157-AS | AM03703-SS | AD02990 | AM03811-AS | AM03726-SS |
| AD02868 | AM03157-AS | AM03704-SS | AD02992 | AM02711-AS | AM03813-SS |
| AD02869 | AM03589-AS | AM03705-SS | AD02993 | AM02711-AS | AM03814-SS |
| AD02870 | AM03590-AS | AM03705-SS | AD02994 | AM02711-AS | AM03815-SS |
| AD02871 | AM03590-AS | AM03706-SS | AD02995 | AM02711-AS | AM03816-SS |
| AD02885 | AM02711-AS | AM03729-SS | AD02996 | AM02711-AS | AM03817-SS |
| AD02886 | AM03359-AS | AM03729-SS | AD02997 | AM02711-AS | AM03818-SS |
| AD02887 | AM02711-AS | AM03730-SS | AD02998 | AM03809-AS | AM03812-SS |
| AD02888 | AM03359-AS | AM03730-SS | AD02999 | AM03810-AS | AM03812-SS |
| AD02889 | AM03732-AS | AM03726-SS | AD03000 | AM03811-AS | AM03812-SS |
| AD02890 | AM03736-AS | AM03726-SS | AD03001 | AM03809-AS | AM03815-SS |
| AD02891 | AM03732-AS | AM03729-SS | AD03002 | AM03810-AS | AM03815-SS |
| AD02892 | AM03736-AS | AM03729-SS | AD03003 | AM03811-AS | AM03815-SS |
| AD02893 | AM03349-AS | AM03726-SS | AD03004 | AM03809-AS | AM03818-SS |
| AD02894 | AM03350-AS | AM03726-SS | AD03005 | AM03810-AS | AM03818-SS |
| AD02895 | AM03351-AS | AM03726-SS | AD03006 | AM03811-AS | AM03818-SS |
| AD02896 | AM03733-AS | AM03726-SS | AD03007 | AM03819-AS | AM03653-SS |
| AD02897 | AM03353-AS | AM03726-SS | AD03008 | AM03820-AS | AM03653-SS |
| AD02898 | AM03734-AS | AM03726-SS | AD03009 | AM03821-AS | AM03653-SS |
| AD02899 | AM03359-AS | AM03727-SS | AD03010 | AM03822-AS | AM03653-SS |
| AD02900 | AM03359-AS | AM03728-SS | AD03014 | AM03832-AS | AM03726-SS |
| AD02901 | AM03735-AS | AM03731-SS | AD03015 | AM03833-AS | AM03726-SS |
| AD02902 | AM03737-AS | AM03731-SS | AD03016 | AM03832-AS | AM03834-SS |
| AD02903 | AM03157-AS | AM03738-SS | AD03017 | AM03833-AS | AM03834-SS |
| AD02904 | AM03157-AS | AM03739-SS | AD03018 | AM02711-AS | AM03834-SS |
| AD02905 | AM03732-AS | AM03730-SS | AD03019 | AM03581-AS | AM03632-SS |
| AD02906 | AM03736-AS | AM03730-SS | AD03020 | AM03581-AS | AM03836-SS |
| AD02950 | AM03581-AS | AM03654-SS | AD03021 | AM03787-AS | AM03836-SS |
| AD02951 | AM03581-AS | AM03775-SS | AD03022 | AM03581-AS | AM03838-SS |
| AD02952 | AM03785-AS | AM03653-SS | AD03023 | AM03581-AS | AM03840-SS |
| AD02953 | AM03786-AS | AM03775-SS | AD03024 | AM03581-AS | AM03842-SS |
| AD02954 | AM03581-AS | AM03776-SS | AD03025 | AM03581-AS | AM03844-SS |
| AD02955 | AM03581-As | AM03777-SS | AD03026 | AM03803-AS | AM03632-SS |
| AD02956 | AM03787-AS | AM03776-SS | AD03027 | AM03804-AS | AM03632-SS |
| AD02957 | AM03785-AS | AM03778-SS | AD03028 | AM03805-AS | AM03632-SS |
| AD02958 | AM03581-AS | AM03779-SS | AD03029 | AM03581-AS | AM03846-SS |
| AD02959 | AM03788-AS | AM03653-SS | AD03030 | AM03581-AS | AM03848-SS |
| AD02960 | AM03581-AS | AM03780-SS | AD03031 | AM03581-AS | AM03850-SS |
| AD02961 | AM03789-AS | AM03775-SS | AD03032 | AM03851-AS | AM03632-SS |
| AD02962 | AM03789-AS | AM03781-SS | AD03033 | AM03852-AS | AM03632-SS |
| AD02963 | AM03581-AS | AM03781-SS | AD03034 | AM03853-AS | AM03632-SS |
| AD02964 | AM03790-AS | AM03781-SS | AD03035 | AM03854-AS | AM03632-SS |
| AD02965 | AM03791-AS | AM03775-SS | AD03036 | AM03851-AS | AM03846-SS |
| AD02966 | AM03792-AS | AM03775-SS | AD03037 | AM03852-AS | AM03846-SS |
| AD02967 | AM03793-AS | AM03775-SS | AD03038 | AM03853-AS | AM03846-SS |
| AD02968 | AM03794-AS | AM03775-SS | AD03039 | AM03854-AS | AM03846-SS |
| AD02969 | AM03581-AS | AM03782-SS | AD03040 | AM03851-AS | AM03848-SS |
| AD02970 | AM03581-AS | AM03783-SS | AD03041 | AM03852-AS | AM03848-SS |
| AD02971 | AM03581-AS | AM03784-SS | AD03042 | AM03853-AS | AM03848-SS |
| AD02972 | AM03795-AS | AM03775-SS | AD03043 | AM03854-AS | AM03848-SS |
| AD02973 | AM03796-AS | AM03775-SS | AD03044 | AM03851-AS | AM03850-SS |
| AD02974 | AM03797-AS | AM03775-SS | AD03045 | AM03852-AS | AM03850-SS |

TABLE 24-continued

F12 RNAi triggers identified by Duplex ID No. with corresponding sense and antisense strands.

| Duplex ID | Antisense Strand ID | Sense Strand ID | Duplex ID | Antisense Strand ID | Sense Strand ID |
|---|---|---|---|---|---|
| AD02975 | AM03798-AS | AM03775-SS | AD03046 | AM03853-AS | AM03850-SS |
| AD02976 | AM03799-AS | AM03402-SS | AD03047 | AM03854-AS | AM03850-SS |
| AD02977 | AM03581-AS | AM03800-SS | AD03048 | AM03855-AS | AM03402-SS |
| AD02978 | AM03581-AS | AM03801-SS | AD03076 | AM03851-AS | AM03886-SS |
| AD02979 | AM03581-AS | AM03802-SS | | | |

Other Embodiments: It is to be understood that while the invention has been described in conjunction with the detailed description thereof, the foregoing description is intended to illustrate and not limit the scope of the invention, which is defined by the scope of the appended claims. Other aspects. advantages, and modifications are within the scope of the following claims.

SEQUENCE LISTING (2322 sequences)

SEQ ID NO: 1 - DNA, 21 bp, artificial sequence
  antisense strand of an RNAi agent
  modified_base 2-19: /mod_base = "2'-hydroxy corresponding nucleoside"
tggugguagcacaccagggtt

SEQ ID NO: 2 - DNA, 21 bp, artificial sequence
  antisense strand of an RNAi agent
  modified_base 2-19: /mod_base = "2'-hydroxy corresponding nucleoside"
tgggugguagcacaccaggtt

SEQ ID NO: 3 - DNA, 21 bp, artificial sequence
  antisense strand of an RNAi agent
  modified_base 2-19: /mod_base = "2'-hydroxy corresponding nucleoside"
tggggugguagcacaccagtt

SEQ ID NO: 4 - DNA, 21 bp, artificial sequence
  antisense strand of an RNAi agent
  modified_base 2-19: /mod_base = "2'-hydroxy corresponding nucleoside"
tcacuuucuugggcuccaatt

SEQ ID NO: 5 - DNA, 21 bp, artificial sequence
  antisense strand of an RNAi agent
  modified_base 2-19: /mod_base = "2'-hydroxy corresponding nucleoside"
tucacuuucuugggcuccatt

SEQ ID NO: 6 - DNA, 21 bp, artificial sequence
  antisense strand of an RNAi agent
  modified_base 2-19: /mod_base = "2'-hydroxy corresponding nucleoside"
tuucacuuucuugggcucctt

SEQ ID NO: 7 - DNA, 21 bp, artificial sequence
  antisense strand of an RNAi agent
  modified_base 2-19: /mod_base = "2'-hydroxy corresponding nucleoside"
tuuucacuuucuugggcuctt

SEQ ID NO: 8 - DNA, 21 bp, artificial sequence
  antisense strand of an RNAi agent
  modified_base 2-19: /mod_base = "2'-hydroxy corresponding nucleoside"
tcuuucacuuucuugggcutt

SEQ ID NO: 9 - DNA, 21 bp, artificial sequence
  antisense strand of an RNAi agent
  modified_base 2-19: /mod_base = "2'-hydroxy corresponding nucleoside"
tucuuucacuuucuugggctt

SEQ ID NO: 10 - DNA, 21 bp, artificial sequence
  antisense strand of an RNAi agent
  modified_base 2-19: /mod_base = "2'-hydroxy corresponding nucleoside"
tgucuuucacuuucuugggtt

SEQ ID NO: 11 - DNA, 21 bp, artificial sequence
  antisense strand of an RNAi agent
  modified_base 2-19: /mod_base = "2'-hydroxy corresponding nucleoside"
tggucuuucacuuucuuggtt

SEQ ID NO: 12 - DNA, 21 bp, artificial sequence
  antisense strand of an RNAi agent
  modified_base 2-19: /mod_base = "2'-hydroxy corresponding nucleoside"
tuggucuuucacuuucuugtt

SEQ ID NO: 13 - DNA, 21 bp, artificial sequence
  antisense strand of an RNAi agent
  modified_base 2-19: /mod_base = "2'-hydroxy corresponding nucleoside"
tagcugaggcucaaagcactt

SEQ ID NO: 14 - DNA, 21 bp, artificial sequence
  antisense strand of an RNAi agent
  modified_base 2-19: /mod_base = "2'-hydroxy corresponding nucleoside"
taagcugaggcucaaagcatt

SEQ ID NO: 15 - DNA, 21 bp, artificial sequence
  antisense strand of an RNAi agent
  modified_base 2-19: /mod_base = "2'-hydroxy corresponding nucleoside"
tgaagcugaggcucaaagctt

SEQ ID NO: 16 - DNA, 21 bp, artificial sequence
  antisense strand of an RNAi agent
  modified_base 2-19: /mod_base = "2'-hydroxy corresponding nucleoside"
tgagaagcugaggcucaaatt

SEQ ID NO: 17 - DNA, 21 bp, artificial sequence
  antisense strand of an RNAi agent
  modified_base 2-19: /mod_base = "2'-hydroxy corresponding nucleoside"
tgcaggccuggcuggccagtt

SEQ ID NO: 18 - DNA, 21 bp, artificial sequence
  antisense strand of an RNAi agent
  modified_base 2-19: /mod_base = "2'-hydroxy corresponding nucleoside"
tgcccccucgaacugguggtt

SEQ ID NO: 19 - DNA, 21 bp, artificial sequence
  antisense strand of an RNAi agent
  modified_base 2-19: /mod_base = "2'-hydroxy corresponding nucleoside"
tuugcggucaccacagccctt

SEQ ID NO: 20 - DNA, 21 bp, artificial sequence
  antisense strand of an RNAi agent
  modified_base 2-19: /mod_base = "2'-hydroxy corresponding nucleoside"
tguugcggucaccacagcctt

SEQ ID NO: 21 - DNA, 21 bp, artificial sequence
  antisense strand of an RNAi agent
  modified_base 2-19: /mod_base = "2'-hydroxy corresponding nucleoside"
tuguugcggucaccacagctt

SEQ ID NO: 22 - DNA, 21 bp, artificial sequence
  antisense strand of an RNAi agent
  modified_base 2-19: /mod_base = "2'-hydroxy corresponding nucleoside"
tuuguugcggucaccacagtt

SEQ ID NO: 23 - DNA, 21 bp, artificial sequence
  antisense strand of an RNAi agent
  modified_base 2-19: /mod_base = "2'-hydroxy corresponding nucleoside"
tcuuguugcggucaccacatt

SEQ ID NO: 24 - DNA, 21 bp, artificial sequence
  antisense strand of an RNAi agent
  modified_base 2-19: /mod_base = "2'-hydroxy corresponding nucleoside"
tgcuuguugcggucaccactt

SEQ ID NO: 25 - DNA, 21 bp, artificial sequence
  antisense strand of an RNAi agent
  modified_base 2-19: /mod_base = "2'-hydroxy corresponding nucleoside"
tggcuuguugcggucaccatt

SEQ ID NO: 26 - DNA, 21 bp, artificial sequence
  antisense strand of an RNAi agent
  modified_base 2-19: /mod_base = "2'-hydroxy corresponding nucleoside"
taagcacuuuauugaguuctt

SEQ ID NO: 27 - DNA, 21 bp, artificial sequence
  antisense strand of an RNAi agent
  modified_base 2-19: /mod_base = "2'-hydroxy corresponding nucleoside"
taaagcacuuuauugaguutt

SEQ ID NO: 28 - DNA, 21 bp, artificial sequence
  antisense strand of an RNAi agent
  modified_base 2-19: /mod_base = "2'-hydroxy corresponding nucleoside"
tcaaagcacuuuauugagutt

SEQ ID NO: 29 - DNA, 21 bp, artificial sequence
  antisense strand of an RNAi agent
  modified_base 2-19: /mod_base = "2'-hydroxy corresponding nucleoside"
tucaaagcacuuuauugagtt

SEQ ID NO: 30 - DNA, 21 bp, artificial sequence
  antisense strand of an RNAi agent
  modified_base 2-19: /mod_base = "2'-hydroxy corresponding nucleoside"
tuucaaagcacuuuauugatt

SEQ ID NO: 31 - DNA, 21 bp, artificial sequence
  antisense strand of an RNAi agent
  modified_base 2-19: /mod_base = "2'-hydroxy corresponding nucleoside"
tuuucaaagcacuuuauugtt

SEQ ID NO: 32 - DNA, 21 bp, artificial sequence
  antisense strand of an RNAi agent
  modified_base 2-19: /mod_base = "2'-hydroxy corresponding nucleoside"
tuuuucaaagcacuuuauutt

SEQ ID NO: 33 - DNA, 21 bp, artificial sequence
  antisense strand of an RNAi agent
  modified_base 2-19: /mod_base = "2'-hydroxy corresponding nucleoside"
tcauccguccguugguccatt

SEQ ID NO: 34 - DNA, 21 bp, artificial sequence
  antisense strand of an RNAi agent
  modified_base 2-19: /mod_base = "2'-hydroxy corresponding nucleoside"
tgcauccguccguuggucctt

SEQ ID NO: 35 - DNA, 21 bp, artificial sequence
  antisense strand of an RNAi agent
  modified_base 2-19: /mod_base = "2'-hydroxy corresponding nucleoside"
tggcauccguccguugguctt

SEQ ID NO: 36 - DNA, 21 bp, artificial sequence
  antisense strand of an RNAi agent
  modified_base 2-19: /mod_base = "2'-hydroxy corresponding nucleoside"
tuggcauccguccguuggutt

SEQ ID NO: 37 - DNA, 21 bp, artificial sequence
  antisense strand of an RNAi agent
  modified_base 2-19: /mod_base = "2'-hydroxy corresponding nucleoside"
tauggcauccguccguuggtt

SEQ ID NO: 38 - DNA, 21 bp, artificial sequence
  antisense strand of an RNAi agent
  modified_base 2-19: /mod_base = "2'-hydroxy corresponding nucleoside"
tcauggcauccguccguugtt

SEQ ID NO: 39 - DNA, 21 bp, artificial sequence
  antisense strand of an RNAi agent
  modified_base 2-19: /mod_base = "2'-hydroxy corresponding nucleoside"
tucauggcauccguccguutt

SEQ ID NO: 40 - DNA, 21 bp, artificial sequence
  antisense strand of an RNAi agent
  modified_base 2-19: /mod_base = "2'-hydroxy corresponding nucleoside"
tcucauggcauccguccgutt

SEQ ID NO: 41 - DNA, 21 bp, artificial sequence
  antisense strand of an RNAi agent
  modified_base 2-19: /mod_base = "2'-hydroxy corresponding nucleoside"
tcagagcccucauggcauctt

SEQ ID NO: 42 - DNA, 21 bp, artificial sequence
  antisense strand of an RNAi agent
  modified_base 2-19: /mod_base = "2'-hydroxy corresponding nucleoside"
tgcagagcccucauggcautt

SEQ ID NO: 43 - DNA, 21 bp, artificial sequence
  antisense strand of an RNAi agent
  modified_base 2-19: /mod_base = "2'-hydroxy corresponding nucleoside"
taccccaggagcagcagagtt

SEQ ID NO: 44 - DNA, 21 bp, artificial sequence
  antisense strand of an RNAi agent
  modified_base 2-19: /mod_base = "2'-hydroxy corresponding nucleoside"
tgggaaguggcagggcucctt

SEQ ID NO: 45 - DNA, 21 bp, artificial sequence
  antisense strand of an RNAi agent
  modified_base 2-19: /mod_base = "2'-hydroxy corresponding nucleoside"
tugguacagcugccgguggtt

SEQ ID NO: 46 - DNA, 21 bp, artificial sequence
  antisense strand of an RNAi agent
  modified_base 2-19: /mod_base = "2'-hydroxy corresponding nucleoside"
tcugguccugaucaaaguutt

SEQ ID NO: 47 - DNA, 21 bp, artificial sequence
  antisense strand of an RNAi agent
  modified_base 2-19: /mod_base = "2'-hydroxy corresponding nucleoside"
tgcugguccugaucaaagutt

SEQ ID NO: 48 - DNA, 21 bp, artificial sequence
  antisense strand of an RNAi agent
  modified_base 2-19: /mod_base = "2'-hydroxy corresponding nucleoside"
tucgcugguccugaucaaatt

SEQ ID NO: 49 - DNA, 21 bp, artificial sequence
  antisense strand of an RNAi agent
  modified_base 2-19: /mod_base = "2'-hydroxy corresponding nucleoside"
tccaucgcugguccugauctt

SEQ ID NO: 50 - DNA, 21 bp, artificial sequence
  antisense strand of an RNAi agent
  modified_base 2-19: /mod_base = "2'-hydroxy corresponding nucleoside"
tcccaucgcugguccugautt

SEQ ID NO: 51 - DNA, 21 bp, artificial sequence
  antisense strand of an RNAi agent
  modified_base 2-19: /mod_base = "2'-hydroxy corresponding nucleoside"
tuccccaucgcugguccugtt

SEQ ID NO: 52 - DNA, 21 bp, artificial sequence
  antisense strand of an RNAi agent
  modified_base 2-19: /mod_base = "2'-hydroxy corresponding nucleoside"
tcuuucuugggcuccaaactt

SEQ ID NO: 53 - DNA, 21 bp, artificial sequence
  antisense strand of an RNAi agent
  modified_base 2-19: /mod_base = "2'-hydroxy corresponding nucleoside"
tacuuucuugggcuccaaatt

SEQ ID NO: 54 - DNA, 21 bp, artificial sequence
  antisense strand of an RNAi agent
  modified_base 2-19: /mod_base = "2'-hydroxy corresponding nucleoside"
tcugagcccgcggccaucatt

SEQ ID NO: 55 - DNA, 21 bp, artificial sequence
  antisense strand of an RNAi agent
  modified_base 2-19: /mod_base = "2'-hydroxy corresponding nucleoside"
tuccgaggcccacggcugatt

SEQ ID NO: 56 - DNA, 21 bp, artificial sequence
  antisense strand of an RNAi agent
  modified_base 2-19: /mod_base = "2'-hydroxy corresponding nucleoside"
tcuccgaggcccacggcugtt

SEQ ID NO: 57 - DNA, 21 bp, artificial sequence
  antisense strand of an RNAi agent
  modified_base 2-19: /mod_base = "2'-hydroxy corresponding nucleoside"
tccuccgaggcccacggcutt

SEQ ID NO: 58 - DNA, 21 bp, artificial sequence
  antisense strand of an RNAi agent
  modified_base 2-19: /mod_base = "2'-hydroxy corresponding nucleoside"
tgguggccuccgaggcccatt

SEQ ID NO: 59 - DNA, 21 bp, artificial sequence
  antisense strand of an RNAi agent
  modified_base 2-19: /mod_base = "2'-hydroxy corresponding nucleoside"
tagguggccuccgaggccctt

SEQ ID NO: 60 - DNA, 21 bp, artificial sequence
  antisense strand of an RNAi agent
  modified_base 2-19: /mod_base = "2'-hydroxy corresponding nucleoside"
tuagguggccuccgaggcctt

SEQ ID NO: 61 - DNA, 21 bp, artificial sequence
  antisense strand of an RNAi agent
  modified_base 2-19: /mod_base = "2'-hydroxy corresponding nucleoside"
tguagguggccuccgaggctt

SEQ ID NO: 62 - DNA, 21 bp, artificial sequence
  antisense strand of an RNAi agent
  modified_base 2-19: /mod_base = "2'-hydroxy corresponding nucleoside"
tguccccaguuccgcgcuutt

SEQ ID NO: 63 - DNA, 21 bp, artificial sequence
  antisense strand of an RNAi agent
  modified_base 2-19: /mod_base = "2'-hydroxy corresponding nucleoside"
tuuccggcagaaggcguggtt

SEQ ID NO: 64 - DNA, 21 bp, artificial sequence
  antisense strand of an RNAi agent
  modified_base 2-19: /mod_base = "2'-hydroxy corresponding nucleoside"
tguuccggcagaaggcgugtt

SEQ ID NO: 65 - DNA, 21 bp, artificial sequence
  antisense strand of an RNAi agent
  modified_base 2-19: /mod_base = "2'-hydroxy corresponding nucleoside"
tgguuccggcagaaggcgutt

SEQ ID NO: 66 - DNA, 21 bp, artificial sequence
  antisense strand of an RNAi agent
  modified_base 2-19: /mod_base = "2'-hydroxy corresponding nucleoside"
tccggguuccggcagaaggtt

SEQ ID NO: 67 - DNA, 21 bp, artificial sequence
  antisense strand of an RNAi agent
  modified_base 2-19: /mod_base = "2'-hydroxy corresponding nucleoside"
tuccggguuccggcagaagtt

SEQ ID NO: 68 - DNA, 21 bp, artificial sequence
  antisense strand of an RNAi agent
  modified_base 2-19: /mod_base = "2'-hydroxy corresponding nucleoside"
tguccggguuccggcagaatt

SEQ ID NO: 69 - DNA, 21 bp, artificial sequence
  antisense strand of an RNAi agent
  modified_base 2-19: /mod_base = "2'-hydroxy corresponding nucleoside"
tuguccggguuccggcagatt

SEQ ID NO: 70 - DNA, 21 bp, artificial sequence
  antisense strand of an RNAi agent
  modified_base 2-19: /mod_base = "2'-hydroxy corresponding nucleoside"
tcguuguccggguuccggctt

SEQ ID NO: 71 - DNA, 21 bp, artificial sequence
  antisense strand of an RNAi agent
  modified_base 2-19: /mod_base = "2'-hydroxy corresponding nucleoside"
tucguuguccggguuccggtt

SEQ ID NO: 72 - DNA, 21 bp, artificial sequence
  antisense strand of an RNAi agent
  modified_base 2-19: /mod_base = "2'-hydroxy corresponding nucleoside"
tuuccuggucagggaaggctt

SEQ ID NO: 73 - DNA, 21 bp, artificial sequence
  antisense strand of an RNAi agent
  modified_base 2-19: /mod_base = "2'-hydroxy corresponding nucleoside"
tguuccuggucagggaaggtt

SEQ ID NO: 74 - DNA, 21 bp, artificial sequence
  antisense strand of an RNAi agent
  modified_base 2-19: /mod_base = "2'-hydroxy corresponding nucleoside"
tcguuccuggucagggaagtt

SEQ ID NO: 75 - DNA, 21 bp, artificial sequence
  antisense strand of an RNAi agent
  modified_base 2-19: /mod_base = "2'-hydroxy corresponding nucleoside"
tccguuccuggucagggaatt

SEQ ID NO: 76 - DNA, 21 bp, artificial sequence
  antisense strand of an RNAi agent
  modified_base 2-19: /mod_base = "2'-hydroxy corresponding nucleoside"
tgccguuccuggucagggatt

SEQ ID NO: 77 - DNA, 21 bp, artificial sequence
  antisense strand of an RNAi agent
  modified_base 2-19: /mod_base = "2'-hydroxy corresponding nucleoside"
tcagugggccguuccuggutt

SEQ ID NO: 78 - DNA, 21 bp, artificial sequence
  antisense strand of an RNAi agent
  modified_base 2-19: /mod_base = "2'-hydroxy corresponding nucleoside"
tagcucagugggccguucctt

SEQ ID NO: 79 - DNA, 21 bp, artificial sequence
  antisense strand of an RNAi agent
  modified_base 2-19: /mod_base = "2'-hydroxy corresponding nucleoside"
tgaagacagacucuugcggtt

SEQ ID NO: 80 - DNA, 21 bp, artificial sequence
  antisense strand of an RNAi agent
  modified_base 2-19: /mod_base = "2'-hydroxy corresponding nucleoside"
tugccggcgcagaaacugutt

SEQ ID NO: 81 - DNA, 21 bp, artificial sequence
  antisense strand of an RNAi agent
  modified_base 2-19: /mod_base = "2'-hydroxy corresponding nucleoside"
tggcgaugaggcugccggctt

SEQ ID NO: 82 - DNA, 21 bp, artificial sequence
  antisense strand of an RNAi agent
  modified_base 2-19: /mod_base = "2'-hydroxy corresponding nucleoside"
tgggcgaugaggcugccggtt

SEQ ID NO: 83 - DNA, 21 bp, artificial sequence
  antisense strand of an RNAi agent
  modified_base 2-19: /mod_base = "2'-hydroxy corresponding nucleoside"
tggggcgaugaggcugccgtt

SEQ ID NO: 84 - DNA, 21 bp, artificial sequence
  antisense strand of an RNAi agent
  modified_base 2-19: /mod_base = "2'-hydroxy corresponding nucleoside"
tacccagcagggggcgaugtt

SEQ ID NO: 85 - DNA, 21 bp, artificial sequence
  antisense strand of an RNAi agent
  modified_base 2-19: /mod_base = "2'-hydroxy corresponding nucleoside"
tgcacccagcagggggcgatt

SEQ ID NO: 86 - DNA, 21 bp, artificial sequence
  antisense strand of an RNAi agent
  modified_base 2-19: /mod_base = "2'-hydroxy corresponding nucleoside"
tagcacccagcagggggcgtt

SEQ ID NO: 87 - DNA, 21 bp, artificial sequence
  antisense strand of an RNAi agent
  modified_base 2-19: /mod_base = "2'-hydroxy corresponding nucleoside"
tucagcacccagcagggggtt

SEQ ID NO: 88 - DNA, 21 bp, artificial sequence
  antisense strand of an RNAi agent
  modified_base 2-19: /mod_base = "2'-hydroxy corresponding nucleoside"
tccgagcaccaccgucagatt

SEQ ID NO: 89 - DNA, 21 bp, artificial sequence
  antisense strand of an RNAi agent
  modified_base 2-19: /mod_base = "2'-hydroxy corresponding nucleoside"
tggccgagcaccaccgucatt

SEQ ID NO: 90 - DNA, 21 bp, artificial sequence
  antisense strand of an RNAi agent
  modified_base 2-19: /mod_base = "2'-hydroxy corresponding nucleoside"
tuggccgagcaccaccguctt

SEQ ID NO: 91 - DNA, 21 bp, artificial sequence
  antisense strand of an RNAi agent
  modified_base 2-19: /mod_base = "2'-hydroxy corresponding nucleoside"
tuccuggccgagcaccacctt

SEQ ID NO: 92 - DNA, 21 bp, artificial sequence
  antisense strand of an RNAi agent
  modified_base 2-19: /mod_base = "2'-hydroxy corresponding nucleoside"
tcagcugccguccgcaucctt

SEQ ID NO: 93 - DNA, 21 bp, artificial sequence
  antisense strand of an RNAi agent
  modified_base 2-19: /mod_base = "2'-hydroxy corresponding nucleoside"
tggagcgcgcagcugccgutt

SEQ ID NO: 94 - DNA, 21 bp, artificial sequence
  antisense strand of an RNAi agent
  modified_base 2-19: /mod_base = "2'-hydroxy corresponding nucleoside"
tacguaaggcgacaggagctt

SEQ ID NO: 95 - DNA, 21 bp, artificial sequence
  antisense strand of an RNAi agent
  modified_base 2-19: /mod_base = "2'-hydroxy corresponding nucleoside"
tcugaacguaaggcgacagtt

SEQ ID NO: 96 - DNA, 21 bp, artificial sequence
  antisense strand of an RNAi agent
  modified_base 2-19: /mod_base = "2'-hydroxy corresponding nucleoside"
tcuggcauauuccuccgcctt

SEQ ID NO: 97 - DNA, 21 bp, artificial sequence
  antisense strand of an RNAi agent
  modified_base 2-19: /mod_base = "2'-hydroxy corresponding nucleoside"
tagcuggcauauuccuccgtt

SEQ ID NO: 98 - DNA, 21 bp, artificial sequence
  antisense strand of an RNAi agent
  modified_base 2-19: /mod_base = "2'-hydroxy corresponding nucleoside"
tgaagcuggcauauuccuctt

SEQ ID NO: 99 - DNA, 21 bp, artificial sequence
  antisense strand of an RNAi agent
  modified_base 2-19: /mod_base = "2'-hydroxy corresponding nucleoside"
tggaagcuggcauauuccutt

SEQ ID NO: 100 - DNA, 21 bp, artificial sequence
  antisense strand of an RNAi agent
  modified_base 2-19: /mod_base = "2'-hydroxy corresponding nucleoside"
tcgggccuccggaaucacctt

SEQ ID NO: 101 - DNA, 21 bp, artificial sequence
  antisense strand of an RNAi agent
  modified_base 2-19: /mod_base = "2'-hydroxy corresponding nucleoside"
tgccacucucucacugcggtt

SEQ ID NO: 102 - DNA, 21 bp, artificial sequence
  antisense strand of an RNAi agent
  modified_base 2-19: /mod_base = "2'-hydroxy corresponding nucleoside"
tagccacucucucacugcgtt

SEQ ID NO: 103 - DNA, 21 bp, artificial sequence
  antisense strand of an RNAi agent
  modified_base 2-19: /mod_base = "2'-hydroxy corresponding nucleoside"
taacagagccgucauggcgtt

SEQ ID NO: 104 - DNA, 21 bp, artificial sequence
  antisense strand of an RNAi agent
  modified_base 2-19: /mod_base = "2'-hydroxy corresponding nucleoside"
tcaacagagccgucauggctt

SEQ ID NO: 105 - DNA, 21 bp, artificial sequence
  antisense strand of an RNAi agent
  modified_base 2-19: /mod_base = "2'-hydroxy corresponding nucleoside"
tacaacagagccgucauggtt

SEQ ID NO: 106 - DNA, 21 bp, artificial sequence
  antisense strand of an RNAi agent
  modified_base 2-19: /mod_base = "2'-hydroxy corresponding nucleoside"
taacaacagagccgucaugtt

SEQ ID NO: 107 - DNA, 21 bp, artificial sequence
  antisense strand of an RNAi agent
  modified_base 2-19: /mod_base = "2'-hydroxy corresponding nucleoside"
tgaacaacagagccgucautt

SEQ ID NO: 108 - DNA, 21 bp, artificial sequence
  antisense strand of an RNAi agent
  modified_base 2-19: /mod_base = "2'-hydroxy corresponding nucleoside"
tggaacaacagagccgucatt

SEQ ID NO: 109 - DNA, 21 bp, artificial sequence
  antisense strand of an RNAi agent
  modified_base 2-19: /mod_base = "2'-hydroxy corresponding nucleoside"
tcggugguacugaaagggatt

SEQ ID NO: 110 - DNA, 21 bp, artificial sequence
  antisense strand of an RNAi agent
  modified_base 2-19: /mod_base = "2'-hydroxy corresponding nucleoside"
tuuguggaugcauuuguggtt

SEQ ID NO: 111 - DNA, 21 bp, artificial sequence
  antisense strand of an RNAi agent
  modified_base 2-19: /mod_base = "2'-hydroxy corresponding nucleoside"
tcaagcaguauccccauugtt

SEQ ID NO: 112 - DNA, 21 bp, artificial sequence
  antisense strand of an RNAi agent
  modified_base 2-19: /mod_base = "2'-hydroxy corresponding nucleoside"
tcuccaagcaguauccccatt

SEQ ID NO: 113 - DNA, 21 bp, artificial sequence
  antisense strand of an RNAi agent
  modified_base 2-19: /mod_base = "2'-hydroxy corresponding nucleoside"
tgcuccaagcaguaucccctt

SEQ ID NO: 114 - DNA, 21 bp, artificial sequence
  antisense strand of an RNAi agent
  modified_base 2-19: /mod_base = "2'-hydroxy corresponding nucleoside"
tgggcuccaagcaguaucctt

SEQ ID NO: 115 - DNA, 21 bp, artificial sequence
  antisense strand of an RNAi agent
  modified_base 2-19: /mod_base = "2'-hydroxy corresponding nucleoside"
tguguuugcugcaaugguctt

SEQ ID NO: 116 - DNA, 21 bp, artificial sequence
  antisense strand of an RNAi agent
  modified_base 2-19: /mod_base = "2'-hydroxy corresponding nucleoside"
tuuccgguagguggccucctt

SEQ ID NO: 117 - DNA, 21 bp, artificial sequence
  antisense strand of an RNAi agent
  modified_base 2-19: /mod_base = "2'-hydroxy corresponding nucleoside"
tguuccgguagguggccuctt

SEQ ID NO: 118 - DNA, 21 bp, artificial sequence
  antisense strand of an RNAi agent
  modified_base 2-19: /mod_base = "2'-hydroxy corresponding nucleoside"
tuguuccgguagguggccutt

SEQ ID NO: 119 - DNA, 21 bp, artificial sequence
  antisense strand of an RNAi agent
  modified_base 2-19: /mod_base = "2'-hydroxy corresponding nucleoside"
tcucagucauguuccgguatt

SEQ ID NO: 120 - DNA, 21 bp, artificial sequence
  antisense strand of an RNAi agent
  modified_base 2-19: /mod_base = "2'-hydroxy corresponding nucleoside"
tgacgugugucauuaucugtt

SEQ ID NO: 121 - DNA, 21 bp, artificial sequence
  antisense strand of an RNAi agent
  modified_base 2-19: /mod_base = "2'-hydroxy corresponding nucleoside"
tggacgugugucauuaucutt

SEQ ID NO: 122 - DNA, 21 bp, artificial sequence
  antisense strand of an RNAi agent
  modified_base 2-19: /mod_base = "2'-hydroxy corresponding nucleoside"
tuggacgugugucauuauctt

SEQ ID NO: 123 - DNA, 21 bp, artificial sequence
  antisense strand of an RNAi agent
  modified_base 2-19: /mod_base = "2'-hydroxy corresponding nucleoside"
tauggacgugugucauuautt

SEQ ID NO: 124 - DNA, 21 bp, artificial sequence
  antisense strand of an RNAi agent
  modified_base 2-19: /mod_base = "2'-hydroxy corresponding nucleoside"
taccauggacgugugucautt

SEQ ID NO: 125 - DNA, 21 bp, artificial sequence
  antisense strand of an RNAi agent
  modified_base 2-19: /mod_base = "2'-hydroxy corresponding nucleoside"
taguccgcccaccacgcgctt

SEQ ID NO: 126 - DNA, 21 bp, artificial sequence
  antisense strand of an RNAi agent
  modified_base 2-19: /mod_base = "2'-hydroxy corresponding nucleoside"
tuaguccgcccaccacgcgtt

SEQ ID NO: 127 - DNA, 21 bp, artificial sequence
  antisense strand of an RNAi agent
  modified_base 2-19: /mod_base = "2'-hydroxy corresponding nucleoside"
tcuaguccgcccaccacgctt

SEQ ID NO: 128 - DNA, 21 bp, artificial sequence
  antisense strand of an RNAi agent
  modified_base 2-19: /mod_base = "2'-hydroxy corresponding nucleoside"
tacuaguccgcccaccacgtt

SEQ ID NO: 129 - DNA, 21 bp, artificial sequence
  antisense strand of an RNAi agent
  modified_base 2-19: /mod_base = "2'-hydroxy corresponding nucleoside"
tcagagccacuaguccgcctt

SEQ ID NO: 130 - DNA, 21 bp, artificial sequence
  antisense strand of an RNAi agent
  modified_base 2-19: /mod_base = "2'-hydroxy corresponding nucleoside"
tguuccucgggcgcuggcctt

SEQ ID NO: 131 - DNA, 21 bp, artificial sequence
  antisense strand of an RNAi agent
  modified_base 2-19: /mod_base = "2'-hydroxy corresponding nucleoside"
taguaccacugucaguucctt

SEQ ID NO: 132 - DNA, 21 bp, artificial sequence
  antisense strand of an RNAi agent
  modified_base 2-19: /mod_base = "2'-hydroxy corresponding nucleoside"
tucuugaccaaguaccacutt

SEQ ID NO: 133 - DNA, 21 bp, artificial sequence
  antisense strand of an RNAi agent
  modified_base 2-19: /mod_base = "2'-hydroxy corresponding nucleoside"
tgaucuugaccaaguaccatt

SEQ ID NO: 134 - DNA, 21 bp, artificial sequence
  antisense strand of an RNAi agent
  modified_base 2-19: /mod_base = "2'-hydroxy corresponding nucleoside"
tcgaucuugaccaaguacctt

SEQ ID NO: 135 - DNA, 21 bp, artificial sequence
  antisense strand of an RNAi agent
  modified_base 2-19: /mod_base = "2'-hydroxy corresponding nucleoside"
tggcgaucuugaccaaguatt

SEQ ID NO: 136 - DNA, 21 bp, artificial sequence
  antisense strand of an RNAi agent
  modified_base 2-19: /mod_base = "2'-hydroxy corresponding nucleoside"
tucgugaaggcgguaggagtt

SEQ ID NO: 137 - DNA, 21 bp, artificial sequence
  antisense strand of an RNAi agent
  modified_base 2-19: /mod_base = "2'-hydroxy corresponding nucleoside"
tccucgugaaggcgguaggtt

SEQ ID NO: 138 - DNA, 21 bp, artificial sequence
  antisense strand of an RNAi agent
  modified_base 2-19: /mod_base = "2'-hydroxy corresponding nucleoside"
tcccucgugaaggcgguagtt

SEQ ID NO: 139 - DNA, 21 bp, artificial sequence
  antisense strand of an RNAi agent
  modified_base 2-19: /mod_base = "2'-hydroxy corresponding nucleoside"
tcgcagagcacugucucagtt

SEQ ID NO: 140 - DNA, 21 bp, artificial sequence
  antisense strand of an RNAi agent
  modified_base 2-19: /mod_base = "2'-hydroxy corresponding nucleoside"
tcuucagcccccucgaacutt

SEQ ID NO: 141 - DNA, 21 bp, artificial sequence
  antisense strand of an RNAi agent
  modified_base 2-19: /mod_base = "2'-hydroxy corresponding nucleoside"
tucuucagcccccucgaactt

SEQ ID NO: 142 - DNA, 21 bp, artificial sequence
  antisense strand of an RNAi agent
  modified_base 2-19: /mod_base = "2'-hydroxy corresponding nucleoside"
tauucuucagcccccucgatt

SEQ ID NO: 143 - DNA, 21 bp, artificial sequence
  antisense strand of an RNAi agent
  modified_base 2-19: /mod_base = "2'-hydroxy corresponding nucleoside"
tucuccgugcacguuagagtt

SEQ ID NO: 144 - DNA, 21 bp, artificial sequence
  antisense strand of an RNAi agent
  modified_base 2-19: /mod_base = "2'-hydroxy corresponding nucleoside"
tcgucuccgugcacguuagtt

SEQ ID NO: 145 - DNA, 21 bp, artificial sequence
  antisense strand of an RNAi agent
  modified_base 2-19: /mod_base = "2'-hydroxy corresponding nucleoside"
tuggcgucuccgugcacgutt

SEQ ID NO: 146 - DNA, 21 bp, artificial sequence
  antisense strand of an RNAi agent
  modified_base 1-19: /mod_base = "2'-hydroxy corresponding nucleoside"
acuuucacuuucuugggcutt

SEQ ID NO: 147 - DNA, 21 bp, artificial sequence
  antisense strand of an RNAi agent
  modified_base 1-19: /mod_base = "2'-hydroxy corresponding nucleoside"
aggucuuucacuuucuuggtt

SEQ ID NO: 148 - DNA, 21 bp, artificial sequence
  antisense strand of an RNAi agent
  modified_base 1-19: /mod_base = "2'-hydroxy corresponding nucleoside"
uggucuuucacuuucuuggtt

SEQ ID NO: 149 - RNA, 23 nt, artificial sequence
  antisense strand of an RNAi agent
uggucuuucacuuucuugggcuc

SEQ ID NO: 150 - DNA, 26 bp, artificial sequence
  antisense strand of an RNAi agent
  modified_base 2-26: /mod_base = "2'-hydroxy corresponding nucleoside"
tggucuuucacuuucuugggcucuau

SEQ ID NO: 151 - DNA, 26 bp, artificial sequence
  antisense strand of an RNAi agent
  modified_base 2-24: /mod_base = "2'-hydroxy corresponding nucleoside"
tggucuuucacuuucuugggcucutt

SEQ ID NO: 152 - DNA, 24 bp, artificial sequence
  antisense strand of an RNAi agent
  modified_base 2-24: /mod_base = "2'-hydroxy corresponding nucleoside"
tggucuuucacuuucuugggcucu

SEQ ID NO: 153 - DNA, 23 bp, artificial sequence
  antisense strand of an RNAi agent
  modified_base 2-23: /mod_base = "2'-hydroxy corresponding nucleoside"
tggucuuucacuuucuugggcuc

SEQ ID NO: 154 - DNA, 23 bp, artificial sequence
  antisense strand of an RNAi agent
  modified_base 2-23: /mod_base = "2'-hydroxy corresponding nucleoside"
tcuuucacuuucuugggcuccaa

SEQ ID NO: 155 - DNA, 23 bp, artificial sequence
  antisense strand of an RNAi agent
  modified_base 2-23: /mod_base = "2'-hydroxy corresponding nucleoside"
tucuuucacuuucuugggcucca

SEQ ID NO: 156 - DNA, 23 bp, artificial sequence
  antisense strand of an RNAi agent
  modified_base 2-23: /mod_base = "2'-hydroxy corresponding nucleoside"
tgucuuucacuuucuugggcucc

SEQ ID NO: 157 - DNA, 23 bp, artificial sequence
  antisense strand of an RNAi agent
  modified_base 2-23: /mod_base = "2'-hydroxy corresponding nucleoside"
tuggucuuucacuuucuugggcu

SEQ ID NO: 158 - DNA, 23 bp, artificial sequence
  antisense strand of an RNAi agent
  modified_base 2-23: /mod_base = "2'-hydroxy corresponding nucleoside"
tgagaagcugaggcucaaagcac

SEQ ID NO: 159 - DNA, 26 bp, artificial sequence
  antisense strand of an RNAi agent
  modified_base 2-26: /mod_base = "2'-hydroxy corresponding nucleoside"
tgagaagcugaggcucaaagcacuau

SEQ ID NO: 160 - DNA, 26 bp, artificial sequence
  antisense strand of an RNAi agent
  modified_base 2-26: /mod_base = "2'-hydroxy corresponding nucleoside"
tggucuuucacuuucuugggcauaua

SEQ ID NO: 161 - DNA, 28 bp, artificial sequence
  antisense strand of an RNAi agent
  modified_base 2-28: /mod_base = "2'-hydroxy corresponding nucleoside"
tggucuuucacuuucuugggcucauaua

SEQ ID NO: 162 - DNA, 26 bp, artificial sequence
  antisense strand of an RNAi agent
  modified_base 2-26: /mod_base = "2'-hydroxy corresponding nucleoside"
tgagaagcugaggcucaaagcauaua

SEQ ID NO: 163 - DNA, 28 bp, artificial sequence
  antisense strand of an RNAi agent
  modified_base 2-28: /mod_base = "2'-hydroxy corresponding nucleoside"
tgagaagcugaggcucaaagcacauaua

SEQ ID NO: 164 - DNA, 25 bp, artificial sequence
  antisense strand of an RNAi agent
  modified_base 2-25: /mod_base = "2'-hydroxy corresponding nucleoside"
tggucuuucacuuucuugggcucua

SEQ ID NO: 165 - DNA, 26 bp, artificial sequence
  antisense strand of an RNAi agent
  modified_base 2-26: /mod_base = "2'-hydroxy corresponding nucleoside"
tcacuuucuugggcuccaaacaguau

SEQ ID NO: 166 - DNA, 26 bp, artificial sequence
  antisense strand of an RNAi agent
  modified_base 2-26: /mod_base = "2'-hydroxy corresponding nucleoside"
tucacuuucuugggcuccaaacauau

SEQ ID NO: 167 - DNA, 26 bp, artificial sequence
  antisense strand of an RNAi agent
  modified_base 2-26: /mod_base = "2'-hydroxy corresponding nucleoside"
tuucacuuucuugggcuccaaacuau

SEQ ID NO: 168 - DNA, 26 bp, artificial sequence
  antisense strand of an RNAi agent
  modified_base 2-26: /mod_base = "2'-hydroxy corresponding nucleoside"
tuuucacuuucuugggcuccaaauau

SEQ ID NO: 169 - DNA, 26 bp, artificial sequence
  antisense strand of an RNAi agent
  modified_base 2-26: /mod_base = "2'-hydroxy corresponding nucleoside"
tagcugaggcucaaagcacuucuuau

SEQ ID NO: 170 - DNA, 26 bp, artificial sequence
  antisense strand of an RNAi agent
  modified_base 2-26: /mod_base = "2'-hydroxy corresponding nucleoside"
tgaagcugaggcucaaagcacuuuau

SEQ ID NO: 171 - DNA, 26 bp, artificial sequence
  antisense strand of an RNAi agent
  modified_base 2-26: /mod_base = "2'-hydroxy corresponding nucleoside"
tuuguugcggucaccacagcccguau

SEQ ID NO: 172 - DNA, 26 bp, artificial sequence
  antisense strand of an RNAi agent
  modified_base 2-26: /mod_base = "2'-hydroxy corresponding nucleoside"
tgcuuguugcggucaccacagccuau

SEQ ID NO: 173 - DNA, 26 bp, artificial sequence
  antisense strand of an RNAi agent
  modified_base 2-26: /mod_base = "2'-hydroxy corresponding nucleoside"
tggcuuguugcggucaccacagcuau

SEQ ID NO: 174 - DNA, 19 bp, artificial sequence
  antisense strand of an RNAi agent
  modified_base 2-19: /mod_base = "2'-hydroxy corresponding nucleoside"
tggucuuucacuuucuugg

SEQ ID NO: 175 - DNA, 18 bp, artificial sequence
  antisense strand of an RNAi agent
  modified_base 2-18: /mod_base = "2'-hydroxy corresponding nucleoside"
tggucuuucacuuucuug

SEQ ID NO: 176 - DNA, 17 bp, artificial sequence
  antisense strand of an RNAi agent
  modified_base 2-17: /mod_base = "2'-hydroxy corresponding nucleoside"
tggucuuucacuuucuu

SEQ ID NO: 177 - RNA, 26 nt, artificial sequence
  antisense strand of an RNAi agent
uggucuuucacuuucuugggcucuau

SEQ ID NO: 178 - RNA, 26 nt, artificial sequence
  antisense strand of an RNAi agent
ugaagcugaggcucaaagcacuuuau

SEQ ID NO: 179 - RNA, 18 nt, artificial sequence
  antisense strand of an RNAi agent
ucacuuucuugggcucca

SEQ ID NO: 180 - RNA, 18 nt, artificial sequence
  antisense strand of an RNAi agent
uucacuuucuugggcucc

SEQ ID NO: 181 - RNA, 18 nt, artificial sequence
  antisense strand of an RNAi agent
uuucacuuucuugggcuc

SEQ ID NO: 182 - RNA, 18 nt, artificial sequence
  antisense strand of an RNAi agent
uuuucacuuucuugggcu

SEQ ID NO: 183 - RNA, 18 nt, artificial sequence
  antisense strand of an RNAi agent
ucuuucacuuucuugggc

SEQ ID NO: 184 - RNA, 18 nt, artificial sequence
  antisense strand of an RNAi agent
uucuuucacuuucuuggg

SEQ ID NO: 185 - RNA, 18 nt, artificial sequence
  antisense strand of an RNAi agent
ugucuuucacuuucuugg

SEQ ID NO: 186 - RNA, 18 nt, artificial sequence
  antisense strand of an RNAi agent
uggucuuucacuuucuug

SEQ ID NO: 187 - RNA, 18 nt, artificial sequence
  antisense strand of an RNAi agent
uuggucuuucacuuucuu

SEQ ID NO: 188 - RNA, 18 nt, artificial sequence
  antisense strand of an RNAi agent
uagcugaggcucaaagca

SEQ ID NO: 189 - RNA, 18 nt, artificial sequence
  antisense strand of an RNAi agent
ugaagcugaggcucaaag

SEQ ID NO: 190 - RNA, 18 nt, artificial sequence
  antisense strand of an RNAi agent
ugagaagcugaggcucaa

SEQ ID NO: 191 - RNA, 18 nt, artificial sequence
  antisense strand of an RNAi agent
uuuguugcggucaccaca

SEQ ID NO: 192 - RNA, 18 nt, artificial sequence
  antisense strand of an RNAi agent
ucuuguugcggucaccac

SEQ ID NO: 193 - RNA, 18 nt, artificial sequence
  antisense strand of an RNAi agent
ugcuuguugcggucacca

SEQ ID NO: 194 - RNA, 18 nt, artificial sequence
  antisense strand of an RNAi agent
uggcuuguugcggucacc

SEQ ID NO: 195 - RNA, 17 nt, artificial sequence
  antisense strand of an RNAi agent
ucacuuucuugggcucc

SEQ ID NO: 196 - RNA, 17 nt, artificial sequence
  antisense strand of an RNAi agent
uucacuuucuugggcuc

SEQ ID NO: 197 - RNA, 17 nt, artificial sequence
  antisense strand of an RNAi agent
uuucacuuucuugggcu

SEQ ID NO: 198 - RNA, 17 nt, artificial sequence
  antisense strand of an RNAi agent
uuuucacuuucuugggc

SEQ ID NO: 199 - RNA, 17 nt, artificial sequence
  antisense strand of an RNAi agent
ucuuucacuuucuuggg

SEQ ID NO: 200 - RNA, 17 nt, artificial sequence
  antisense strand of an RNAi agent
uucuuucacuuucuugg

SEQ ID NO: 201 - RNA, 17 nt, artificial sequence
  antisense strand of an RNAi agent
ugucuuucacuuucuug

SEQ ID NO: 202 - RNA, 17 nt, artificial sequence
  antisense strand of an RNAi agent
uggucuuucacuuucuu

SEQ ID NO: 203 - RNA, 17 nt, artificial sequence
  antisense strand of an RNAi agent
uuggucuuucacuuucu

SEQ ID NO: 204 - RNA, 17 nt, artificial sequence
  antisense strand of an RNAi agent
uagcugaggcucaaagc

SEQ ID NO: 205 - RNA, 17 nt, artificial sequence
  antisense strand of an RNAi agent
ugaagcugaggcucaaa

SEQ ID NO: 206 - RNA, 17 nt, artificial sequence
  antisense strand of an RNAi agent
ugagaagcugaggcuca

SEQ ID NO: 207 - RNA, 17 nt, artificial sequence
  antisense strand of an RNAi agent
uuuguugcggucaccac

SEQ ID NO: 208 - RNA, 17 nt, artificial sequence
  antisense strand of an RNAi agent
ucuuguugcggucacca

SEQ ID NO: 209 - RNA, 17 nt, artificial sequence
  antisense strand of an RNAi agent
ugcuuguugcggucacc

SEQ ID NO: 210 - RNA, 17 nt, artificial sequence
  antisense strand of an RNAi agent
uggcuuguugcggucac

SEQ ID NO: 211 - RNA, 24 nt, artificial sequence
  antisense strand of an RNAi agent
ggucuuucacuuucuugggcucua

SEQ ID NO: 212 - RNA, 23 nt, artificial sequence
  antisense strand of an RNAi agent
gucuuucacuuucuugggcucua

SEQ ID NO: 213 - RNA, 22 nt, artificial sequence
  antisense strand of an RNAi agent
ucuuucacuuucuugggcucua

SEQ ID NO: 214 - RNA, 25 nt, artificial sequence
  antisense strand of an RNAi agent
ggucuuucacuuucuugggcucuau

SEQ ID NO: 215 - RNA, 24 nt, artificial sequence
  antisense strand of an RNAi agent
gucuuucacuuucuugggcucuau

SEQ ID NO: 216 - DNA, 26 bp, artificial sequence
  antisense strand of an RNAi agent
  modified_base 2-21,223-26: /mod_base = "2'-hydroxy corresponding nucleoside"
uggucuuucacuuucuugggctcuau

SEQ ID NO: 217 - RNA, 23 nt, artificial sequence
  antisense strand of an RNAi agent
ggucuuucacuuucuugggcucu

SEQ ID NO: 218 - DNA, 22 bp, artificial sequence
  antisense strand of an RNAi agent
  modified_base 2-22: /mod_base = "2'-hydroxy corresponding nucleoside"
tggucuuucacuuucuugggcu

SEQ ID NO: 219 - RNA, 22 nt, artificial sequence
  antisense strand of an RNAi agent
ggucuuucacuuucuugggcuc

SEQ ID NO: 220 - RNA, 26 nt, artificial sequence
  antisense strand of an RNAi agent
uauggucuuucacuuucuugggcucu

SEQ ID NO: 221 - DNA, 21 bp, artificial sequence
  antisense strand of an RNAi agent
  modified_base 2-21: /mod_base = "2'-hydroxy corresponding nucleoside"
tggucuuucacuuucuugggc

SEQ ID NO: 222 - RNA, 26 nt, artificial sequence
  antisense strand of an RNAi agent
uggucuuucacuuucuugggcuucau

SEQ ID NO: 223 - RNA, 26 nt, artificial sequence
  antisense strand of an RNAi agent
uuauggucuuucacuuucuugggcuc

SEQ ID NO: 224 - RNA, 26 nt, artificial sequence
  antisense strand of an RNAi agent
ugauggucuuucacuuucuugggcuc

SEQ ID NO: 225 - DNA, 20 bp, artificial sequence
  sense strand of an RNAi agent
  modified_base 1-19: /mod_base = "2'-hydroxy corresponding nucleoside"
cccuggugugcuaccaccat

SEQ ID NO: 226 - DNA, 20 bp, artificial sequence
  sense strand of an RNAi agent
  modified_base 1-19: /mod_base = "2'-hydroxy corresponding nucleoside"
ccuggugugcuaccacccat

SEQ ID NO: 227 - DNA, 20 bp, artificial sequence
  sense strand of an RNAi agent
  modified_base 1-19: /mod_base = "2'-hydroxy corresponding nucleoside"
cuggugugcuaccaccccat

SEQ ID NO: 228 - DNA, 20 bp, artificial sequence
  sense strand of an RNAi agent
  modified_base 1-19: /mod_base = "2'-hydroxy corresponding nucleoside"
uuggagcccaagaaagugat

SEQ ID NO: 229 - DNA, 20 bp, artificial sequence
  sense strand of an RNAi agent
  modified_base 1-19: /mod_base = "2'-hydroxy corresponding nucleoside"
uggagcccaagaaagugaat

SEQ ID NO: 230 - DNA, 20 bp, artificial sequence
  sense strand of an RNAi agent
  modified_base 1-19: /mod_base = "2'-hydroxy corresponding nucleoside"
ggagcccaagaaagugaaat

SEQ ID NO: 231 - DNA, 20 bp, artificial sequence
  sense strand of an RNAi agent
  modified_base 1-19: /mod_base = "2'-hydroxy corresponding nucleoside"
gagcccaagaaagugaaaat

SEQ ID NO: 232 - DNA, 20 bp, artificial sequence
  sense strand of an RNAi agent
  modified_base 1-19: /mod_base = "2'-hydroxy corresponding nucleoside"
agcccaagaaagugaaagat

SEQ ID NO: 233 - DNA, 20 bp, artificial sequence
  sense strand of an RNAi agent
  modified_base 1-19: /mod_base = "2'-hydroxy corresponding nucleoside"
gcccaagaaagugaaagaat

SEQ ID NO: 234 - DNA, 20 bp, artificial sequence
  sense strand of an RNAi agent
  modified_base 1-19: /mod_base = "2'-hydroxy corresponding nucleoside"
cccaagaaagugaaagacat

SEQ ID NO: 235 - DNA, 20 bp, artificial sequence
  sense strand of an RNAi agent
  modified_base 1-19: /mod_base = "2'-hydroxy corresponding nucleoside"
ccaagaaagugaaagaccat

SEQ ID NO: 236 - DNA, 20 bp, artificial sequence
  sense strand of an RNAi agent
  modified_base 1-19: /mod_base = "2'-hydroxy corresponding nucleoside"
caagaaagugaaagaccaat

SEQ ID NO: 237 - DNA, 20 bp, artificial sequence
  sense strand of an RNAi agent
  modified_base 1-19: /mod_base = "2'-hydroxy corresponding nucleoside"
gugcuuugagccucagcuat

SEQ ID NO: 238 - DNA, 20 bp, artificial sequence
  sense strand of an RNAi agent
  modified_base 1-19: /mod_base = "2'-hydroxy corresponding nucleoside"
ugcuuugagccucagcuuat

SEQ ID NO: 239 - DNA, 20 bp, artificial sequence
  sense strand of an RNAi agent
  modified_base 1-19: /mod_base = "2'-hydroxy corresponding nucleoside"
gcuuugagccucagcuucat

SEQ ID NO: 240 - DNA, 20 bp, artificial sequence
  sense strand of an RNAi agent
  modified_base 1-19: /mod_base = "2'-hydroxy corresponding nucleoside"
uuugagccucagcuucucat

SEQ ID NO: 241 - DNA, 20 bp, artificial sequence
  sense strand of an RNAi agent
  modified_base 1-19: /mod_base = "2'-hydroxy corresponding nucleoside"
cuggccagccaggccugcat

SEQ ID NO: 242 - DNA, 20 bp, artificial sequence
  sense strand of an RNAi agent
  modified_base 1-19: /mod_base = "2'-hydroxy corresponding nucleoside"
ccaccaguucgagggggcat

SEQ ID NO: 243 - DNA, 20 bp, artificial sequence
  sense strand of an RNAi agent
  modified_base 1-19: /mod_base = "2'-hydroxy corresponding nucleoside"
gggcuguggugaccgcaaat

SEQ ID NO: 244 - DNA, 20 bp, artificial sequence
  sense strand of an RNAi agent
  modified_base 1-19: /mod_base = "2'-hydroxy corresponding nucleoside"
ggcuguggugaccgcaacat

SEQ ID NO: 245 - DNA, 20 bp, artificial sequence
  sense strand of an RNAi agent
  modified_base 1-19: /mod_base = "2'-hydroxy corresponding nucleoside"
gcuguggugaccgcaacaat

SEQ ID NO: 246 - DNA, 20 bp, artificial sequence
  sense strand of an RNAi agent
  modified_base 1-19: /mod_base = "2'-hydroxy corresponding nucleoside"
cuguggugaccgcaacaaat

SEQ ID NO: 247 - DNA, 20 bp, artificial sequence
  sense strand of an RNAi agent
  modified_base 1-19: /mod_base = "2'-hydroxy corresponding nucleoside"
uguggugaccgcaacaagat

SEQ ID NO: 248 - DNA, 20 bp, artificial sequence
  sense strand of an RNAi agent
  modified_base 1-19: /mod_base = "2'-hydroxy corresponding nucleoside"
guggugaccgcaacaagcat

SEQ ID NO: 249 - DNA, 20 bp, artificial sequence
  sense strand of an RNAi agent
  modified_base 1-19: /mod_base = "2'-hydroxy corresponding nucleoside"
uggugaccgcaacaagccat

SEQ ID NO: 250 - DNA, 20 bp, artificial sequence
  sense strand of an RNAi agent
  modified_base 1-19: /mod_base = "2'-hydroxy corresponding nucleoside"
gaacucaauaaagugcuuat

SEQ ID NO: 251 - DNA, 20 bp, artificial sequence
  sense strand of an RNAi agent
  modified_base 1-19: /mod_base = "2'-hydroxy corresponding nucleoside"
aacucaauaaagugcuuuat

SEQ ID NO: 252 - DNA, 20 bp, artificial sequence
  sense strand of an RNAi agent
  modified_base 1-19: /mod_base = "2'-hydroxy corresponding nucleoside"
acucaauaaagugcuuugat

SEQ ID NO: 253 - DNA, 20 bp, artificial sequence
  sense strand of an RNAi agent
  modified_base 1-19: /mod_base = "2'-hydroxy corresponding nucleoside"
cucaauaaagugcuuugaat

SEQ ID NO: 254 - DNA, 20 bp, artificial sequence
  sense strand of an RNAi agent
  modified_base 1-19: /mod_base = "2'-hydroxy corresponding nucleoside"
ucaauaaagugcuuugaaat

SEQ ID NO: 255 - DNA, 20 bp, artificial sequence
  sense strand of an RNAi agent
  modified_base 1-19: /mod_base = "2'-hydroxy corresponding nucleoside"
caauaaagugcuuugaaaat

SEQ ID NO: 256 - DNA, 20 bp, artificial sequence
  sense strand of an RNAi agent
  modified_base 1-19: /mod_base = "2'-hydroxy corresponding nucleoside"
aauaaagugcuuugaaaaat

SEQ ID NO: 257 - DNA, 20 bp, artificial sequence
  sense strand of an RNAi agent
  modified_base 1-19: /mod_base = "2'-hydroxy corresponding nucleoside"
uggaccaacggacggaugat

SEQ ID NO: 258 - DNA, 20 bp, artificial sequence
  sense strand of an RNAi agent
  modified_base 1-19: /mod_base = "2'-hydroxy corresponding nucleoside"
ggaccaacggacggaugcat

SEQ ID NO: 259 - DNA, 20 bp, artificial sequence
  sense strand of an RNAi agent
  modified_base 1-19: /mod_base = "2'-hydroxy corresponding nucleoside"
gaccaacggacggaugccat

SEQ ID NO: 260 - DNA, 20 bp, artificial sequence
  sense strand of an RNAi agent
  modified_base 1-19: /mod_base = "2'-hydroxy corresponding nucleoside"
accaacggacggaugccaat

SEQ ID NO: 261 - DNA, 20 bp, artificial sequence
  sense strand of an RNAi agent
  modified_base 1-19: /mod_base = "2'-hydroxy corresponding nucleoside"
ccaacggacggaugccauat

SEQ ID NO: 262 - DNA, 20 bp, artificial sequence
  sense strand of an RNAi agent
  modified_base 1-19: /mod_base = "2'-hydroxy corresponding nucleoside"
caacggacggaugccaugat

SEQ ID NO: 263 - DNA, 20 bp, artificial sequence
  sense strand of an RNAi agent
  modified_base 1-19: /mod_base = "2'-hydroxy corresponding nucleoside"
aacggacggaugccaugaat

SEQ ID NO: 264 - DNA, 20 bp, artificial sequence
  sense strand of an RNAi agent
  modified_base 1-19: /mod_base = "2'-hydroxy corresponding nucleoside"
acggacggaugccaugagat

SEQ ID NO: 265 - DNA, 20 bp, artificial sequence
  sense strand of an RNAi agent
  modified_base 1-19: /mod_base = "2'-hydroxy corresponding nucleoside"
gaugccaugagggcucugat

SEQ ID NO: 266 - DNA, 20 bp, artificial sequence
  sense strand of an RNAi agent
  modified_base 1-19: /mod_base = "2'-hydroxy corresponding nucleoside"
augccaugagggcucugcat

SEQ ID NO: 267 - DNA, 20 bp, artificial sequence
  sense strand of an RNAi agent
  modified_base 1-19: /mod_base = "2'-hydroxy corresponding nucleoside"
cucugcugcuccugggguat

SEQ ID NO: 268 - DNA, 20 bp, artificial sequence
  sense strand of an RNAi agent
  modified_base 1-19: /mod_base = "2'-hydroxy corresponding nucleoside"
ggagcccugccacuucccat

SEQ ID NO: 269 - DNA, 20 bp, artificial sequence
  sense strand of an RNAi agent
  modified_base 1-19: /mod_base = "2'-hydroxy corresponding nucleoside"
ccaccggcagcuguaccaat

SEQ ID NO: 270 - DNA, 20 bp, artificial sequence
  sense strand of an RNAi agent
  modified_base 1-19: /mod_base = "2'-hydroxy corresponding nucleoside"
aacuuugaucaggaccagat

SEQ ID NO: 271 - DNA, 20 bp, artificial sequence
  sense strand of an RNAi agent
  modified_base 1-19: /mod_base = "2'-hydroxy corresponding nucleoside"
acuuugaucaggaccagcat

SEQ ID NO: 272 - DNA, 20 bp, artificial sequence
  sense strand of an RNAi agent
  modified_base 1-19: /mod_base = "2'-hydroxy corresponding nucleoside"
uuugaucaggaccagcgaat

SEQ ID NO: 273 - DNA, 20 bp, artificial sequence
  sense strand of an RNAi agent
  modified_base 1-19: /mod_base = "2'-hydroxy corresponding nucleoside"
gaucaggaccagcgauggat

SEQ ID NO: 274 - DNA, 20 bp, artificial sequence
  sense strand of an RNAi agent
  modified_base 1-19: /mod_base = "2'-hydroxy corresponding nucleoside"
aucaggaccagcgaugggat

SEQ ID NO: 275 - DNA, 20 bp, artificial sequence
  sense strand of an RNAi agent
  modified_base 1-19: /mod_base = "2'-hydroxy corresponding nucleoside"
caggaccagcgauggggaat

SEQ ID NO: 276 - DNA, 20 bp, artificial sequence
  sense strand of an RNAi agent
  modified_base 1-19: /mod_base = "2'-hydroxy corresponding nucleoside"
guuuggagcccaagaaagat

SEQ ID NO: 277 - DNA, 20 bp, artificial sequence
  sense strand of an RNAi agent
  modified_base 1-19: /mod_base = "2'-hydroxy corresponding nucleoside"
uuuggagcccaagaaaguat

SEQ ID NO: 278 - DNA, 20 bp, artificial sequence
  sense strand of an RNAi agent
  modified_base 1-19: /mod_base = "2'-hydroxy corresponding nucleoside"
ugauggccgcgggcucagat

SEQ ID NO: 279 - DNA, 20 bp, artificial sequence
  sense strand of an RNAi agent
  modified_base 1-19: /mod_base = "2'-hydroxy corresponding nucleoside"
ucagccgugggccucggaat

SEQ ID NO: 280 - DNA, 20 bp, artificial sequence
  sense strand of an RNAi agent
  modified_base 1-19: /mod_base = "2'-hydroxy corresponding nucleoside"
cagccgugggccucggagat

SEQ ID NO: 281 - DNA, 20 bp, artificial sequence
  sense strand of an RNAi agent
  modified_base 1-19: /mod_base = "2'-hydroxy corresponding nucleoside"
agccgugggccucggaggat

SEQ ID NO: 282 - DNA, 20 bp, artificial sequence
  sense strand of an RNAi agent
  modified_base 1-19: /mod_base = "2'-hydroxy corresponding nucleoside"
ugggccucggaggccaccat

SEQ ID NO: 283 - DNA, 20 bp, artificial sequence
  sense strand of an RNAi agent
  modified_base 1-19: /mod_base = "2'-hydroxy corresponding nucleoside"
gggccucggaggccaccuat

SEQ ID NO: 284 - DNA, 20 bp, artificial sequence
  sense strand of an RNAi agent
  modified_base 1-19: /mod_base = "2'-hydroxy corresponding nucleoside"
ggccucggaggccaccuaat

SEQ ID NO: 285 - DNA, 20 bp, artificial sequence
  sense strand of an RNAi agent
  modified_base 1-19: /mod_base = "2'-hydroxy corresponding nucleoside"
gccucggaggccaccuacat

SEQ ID NO: 286 - DNA, 20 bp, artificial sequence
  sense strand of an RNAi agent
  modified_base 1-19: /mod_base = "2'-hydroxy corresponding nucleoside"
aagcgcggaacuggggacat

SEQ ID NO: 287 - DNA, 20 bp, artificial sequence
  sense strand of an RNAi agent
  modified_base 1-19: /mod_base = "2'-hydroxy corresponding nucleoside"
ccacgccuucugccggaaat

SEQ ID NO: 288 - DNA, 20 bp, artificial sequence
  sense strand of an RNAi agent
  modified_base 1-19: /mod_base = "2'-hydroxy corresponding nucleoside"
cacgccuucugccggaacat

SEQ ID NO: 289 - DNA, 20 bp, artificial sequence
  sense strand of an RNAi agent
  modified_base 1-19: /mod_base = "2'-hydroxy corresponding nucleoside"
acgccuucugccggaaccat

SEQ ID NO: 290 - DNA, 20 bp, artificial sequence
  sense strand of an RNAi agent
  modified_base 1-19: /mod_base = "2'-hydroxy corresponding nucleoside"
ccuucugccggaacccggat

SEQ ID NO: 291 - DNA, 20 bp, artificial sequence
  sense strand of an RNAi agent
  modified_base 1-19: /mod_base = "2'-hydroxy corresponding nucleoside"
cuucugccggaacccggaat

SEQ ID NO: 292 - DNA, 20 bp, artificial sequence
  sense strand of an RNAi agent
  modified_base 1-19: /mod_base = "2'-hydroxy corresponding nucleoside"
uucugccggaacccggacat

SEQ ID NO: 293 - DNA, 20 bp, artificial sequence
  sense strand of an RNAi agent
  modified_base 1-19: /mod_base = "2'-hydroxy corresponding nucleoside"
ucugccggaacccggacaat

SEQ ID NO: 294 - DNA, 20 bp, artificial sequence
  sense strand of an RNAi agent
  modified_base 1-19: /mod_base = "2'-hydroxy corresponding nucleoside"
gccggaacccggacaacgat

SEQ ID NO: 295 - DNA, 20 bp, artificial sequence
  sense strand of an RNAi agent
  modified_base 1-19: /mod_base = "2'-hydroxy corresponding nucleoside"
ccggaacccggacaacgaat

SEQ ID NO: 296 - DNA, 20 bp, artificial sequence
  sense strand of an RNAi agent
  modified_base 1-19: /mod_base = "2'-hydroxy corresponding nucleoside"
gccuucccugaccaggaaat

SEQ ID NO: 297 - DNA, 20 bp, artificial sequence
  sense strand of an RNAi agent
  modified_base 1-19: /mod_base = "2'-hydroxy corresponding nucleoside"
ccuucccugaccaggaacat

SEQ ID NO: 298 - DNA, 20 bp, artificial sequence
  sense strand of an RNAi agent
  modified_base 1-19: /mod_base = "2'-hydroxy corresponding nucleoside"
cuucccugaccaggaacgat

SEQ ID NO: 299 - DNA, 20 bp, artificial sequence
  sense strand of an RNAi agent
  modified_base 1-19: /mod_base = "2'-hydroxy corresponding nucleoside"
uucccugaccaggaacggat

SEQ ID NO: 300 - DNA, 20 bp, artificial sequence
  sense strand of an RNAi agent
  modified_base 1-19: /mod_base = "2'-hydroxy corresponding nucleoside"
ucccugaccaggaacggcat

SEQ ID NO: 301 - DNA, 20 bp, artificial sequence
  sense strand of an RNAi agent
  modified_base 1-19: /mod_base = "2'-hydroxy corresponding nucleoside"
accaggaacggcccacugat

SEQ ID NO: 302 - DNA, 20 bp, artificial sequence
  sense strand of an RNAi agent
  modified_base 1-19: /mod_base = "2'-hydroxy corresponding nucleoside"
ggaacggcccacugagcuat

SEQ ID NO: 303 - DNA, 20 bp, artificial sequence
  sense strand of an RNAi agent
  modified_base 1-19: /mod_base = "2'-hydroxy corresponding nucleoside"
ccgcaagagucugucuucat

SEQ ID NO: 304 - DNA, 20 bp, artificial sequence
  sense strand of an RNAi agent
  modified_base 1-19: /mod_base = "2'-hydroxy corresponding nucleoside"
acaguuucugcgccggcaat

SEQ ID NO: 305 - DNA, 20 bp, artificial sequence
  sense strand of an RNAi agent
  modified_base 1-19: /mod_base = "2'-hydroxy corresponding nucleoside"
gccggcagccucaucgccat

SEQ ID NO: 306 - DNA, 20 bp, artificial sequence
  sense strand of an RNAi agent
  modified_base 1-19: /mod_base = "2'-hydroxy corresponding nucleoside"
ccggcagccucaucgcccat

SEQ ID NO: 307 - DNA, 20 bp, artificial sequence
  sense strand of an RNAi agent
  modified_base 1-19: /mod_base = "2'-hydroxy corresponding nucleoside"
cggcagccucaucgccccat

SEQ ID NO: 308 - DNA, 20 bp, artificial sequence
  sense strand of an RNAi agent
  modified_base 1-19: /mod_base = "2'-hydroxy corresponding nucleoside"
caucgcccccugcuggguat

SEQ ID NO: 309 - DNA, 20 bp, artificial sequence
  sense strand of an RNAi agent
  modified_base 1-19: /mod_base = "2'-hydroxy corresponding nucleoside"
ucgcccccugcugggugcat

SEQ ID NO: 310 - DNA, 20 bp, artificial sequence
  sense strand of an RNAi agent
  modified_base 1-19: /mod_base = "2'-hydroxy corresponding nucleoside"
cgcccccugcugggugcuat

SEQ ID NO: 311 - DNA, 20 bp, artificial sequence
  sense strand of an RNAi agent
  modified_base 1-19: /mod_base = "2'-hydroxy corresponding nucleoside"
cccccugcugggugcugaat

SEQ ID NO: 312 - DNA, 20 bp, artificial sequence
  sense strand of an RNAi agent
  modified_base 1-19: /mod_base = "2'-hydroxy corresponding nucleoside"
ucugacgguggugcucggat

SEQ ID NO: 313 - DNA, 20 bp, artificial sequence
  sense strand of an RNAi agent
  modified_base 1-19: /mod_base = "2'-hydroxy corresponding nucleoside"
ugacgguggugcucggccat

SEQ ID NO: 314 - DNA, 20 bp, artificial sequence
  sense strand of an RNAi agent
  modified_base 1-19: /mod_base = "2'-hydroxy corresponding nucleoside"
gacgguggugcucggccaat

SEQ ID NO: 315 - DNA, 20 bp, artificial sequence
  sense strand of an RNAi agent
  modified_base 1-19: /mod_base = "2'-hydroxy corresponding nucleoside"
gguggugcucggccaggaat

SEQ ID NO: 316 - DNA, 20 bp, artificial sequence
  sense strand of an RNAi agent
  modified_base 1-19: /mod_base = "2'-hydroxy corresponding nucleoside"
ggaugcggacggcagcugat

SEQ ID NO: 317 - DNA, 20 bp, artificial sequence
  sense strand of an RNAi agent
  modified_base 1-19: /mod_base = "2'-hydroxy corresponding nucleoside"
acggcagcugcgcgcuccat

SEQ ID NO: 318 - DNA, 20 bp, artificial sequence
  sense strand of an RNAi agent
  modified_base 1-19: /mod_base = "2'-hydroxy corresponding nucleoside"
gcuccugucgccuuacguat

SEQ ID NO: 319 - DNA, 20 bp, artificial sequence
  sense strand of an RNAi agent
  modified_base 1-19: /mod_base = "2'-hydroxy corresponding nucleoside"
cugucgccuuacguucagat

SEQ ID NO: 320 - DNA, 20 bp, artificial sequence
  sense strand of an RNAi agent
  modified_base 1-19: /mod_base = "2'-hydroxy corresponding nucleoside"
ggcggaggaauaugccagat

SEQ ID NO: 321 - DNA, 20 bp, artificial sequence
  sense strand of an RNAi agent
  modified_base 1-19: /mod_base = "2'-hydroxy corresponding nucleoside"
cggaggaauaugccagcuat

SEQ ID NO: 322 - DNA, 20 bp, artificial sequence
  sense strand of an RNAi agent
  modified_base 1-19: /mod_base = "2'-hydroxy corresponding nucleoside"
gaggaauaugccagcuucat

SEQ ID NO: 323 - DNA, 20 bp, artificial sequence
  sense strand of an RNAi agent
  modified_base 1-19: /mod_base = "2'-hydroxy corresponding nucleoside"
aggaauaugccagcuuccat

SEQ ID NO: 324 - DNA, 20 bp, artificial sequence
  sense strand of an RNAi agent
  modified_base 1-19: /mod_base = "2'-hydroxy corresponding nucleoside"
ggugauuccggaggcccgat

SEQ ID NO: 325 - DNA, 20 bp, artificial sequence
  sense strand of an RNAi agent
  modified_base 1-19: /mod_base = "2'-hydroxy corresponding nucleoside"
ccgcagugagagaguggcat

SEQ ID NO: 326 - DNA, 20 bp, artificial sequence
  sense strand of an RNAi agent
  modified_base 1-19: /mod_base = "2'-hydroxy corresponding nucleoside"
cgcagugagagaguggcuat

SEQ ID NO: 327 - DNA, 20 bp, artificial sequence
  sense strand of an RNAi agent
  modified_base 1-19: /mod_base = "2'-hydroxy corresponding nucleoside"
cgccaugacggcucuguuat

SEQ ID NO: 328 - DNA, 20 bp, artificial sequence
  sense strand of an RNAi agent
  modified_base 1-19: /mod_base = "2'-hydroxy corresponding nucleoside"
gccaugacggcucuguugat

SEQ ID NO: 329 - DNA, 20 bp, artificial sequence
  sense strand of an RNAi agent
  modified_base 1-19: /mod_base = "2'-hydroxy corresponding nucleoside"
ccaugacggcucuguuguat

SEQ ID NO: 330 - DNA, 20 bp, artificial sequence
  sense strand of an RNAi agent
  modified_base 1-19: /mod_base = "2'-hydroxy corresponding nucleoside"
caugacggcucuguuguuat

SEQ ID NO: 331 - DNA, 20 bp, artificial sequence
  sense strand of an RNAi agent
  modified_base 1-19: /mod_base = "2'-hydroxy corresponding nucleoside"
augacggcucuguuguucat

SEQ ID NO: 332 - DNA, 20 bp, artificial sequence
  sense strand of an RNAi agent
  modified_base 1-19: /mod_base = "2'-hydroxy corresponding nucleoside"
ugacggcucuguuguuccat

SEQ ID NO: 333 - DNA, 20 bp, artificial sequence
  sense strand of an RNAi agent
  modified_base 1-19: /mod_base = "2'-hydroxy corresponding nucleoside"
ucccuuucaguaccaccgat

SEQ ID NO: 334 - DNA, 20 bp, artificial sequence
  sense strand of an RNAi agent
  modified_base 1-19: /mod_base = "2'-hydroxy corresponding nucleoside"
ccacaaaugcauccacaaat

SEQ ID NO: 335 - DNA, 20 bp, artificial sequence
  sense strand of an RNAi agent
  modified_base 1-19: /mod_base = "2'-hydroxy corresponding nucleoside"
caauggggauacugcuugat

SEQ ID NO: 336 - DNA, 20 bp, artificial sequence
  sense strand of an RNAi agent
  modified_base 1-19: /mod_base = "2'-hydroxy corresponding nucleoside"
uggggauacugcuuggagat

SEQ ID NO: 337 - DNA, 20 bp, artificial sequence
  sense strand of an RNAi agent
  modified_base 1-19: /mod_base = "2'-hydroxy corresponding nucleoside"
ggggauacugcuuggagcat

SEQ ID NO: 338 - DNA, 20 bp, artificial sequence
  sense strand of an RNAi agent
  modified_base 1-19: /mod_base = "2'-hydroxy corresponding nucleoside"
ggauacugcuuggagcccat

SEQ ID NO: 339 - DNA, 20 bp, artificial sequence
  sense strand of an RNAi agent
  modified_base 1-19: /mod_base = "2'-hydroxy corresponding nucleoside"
gaccauugcagcaaacacat

SEQ ID NO: 340 - DNA, 20 bp, artificial sequence
  sense strand of an RNAi agent
  modified_base 1-19: /mod_base = "2'-hydroxy corresponding nucleoside"
ggaggccaccuaccggaaat

SEQ ID NO: 341 - DNA, 20 bp, artificial sequence
  sense strand of an RNAi agent
  modified_base 1-19: /mod_base = "2'-hydroxy corresponding nucleoside"
gaggccaccuaccggaacat

SEQ ID NO: 342 - DNA, 20 bp, artificial sequence
  sense strand of an RNAi agent
  modified_base 1-19: /mod_base = "2'-hydroxy corresponding nucleoside"
aggccaccuaccggaacaat

SEQ ID NO: 343 - DNA, 20 bp, artificial sequence
  sense strand of an RNAi agent
  modified_base 1-19: /mod_base = "2'-hydroxy corresponding nucleoside"
uaccggaacaugacugagat

SEQ ID NO: 344 - DNA, 20 bp, artificial sequence
  sense strand of an RNAi agent
  modified_base 1-19: /mod_base = "2'-hydroxy corresponding nucleoside"
cagauaaugacacacgucat

SEQ ID NO: 345 - DNA, 20 bp, artificial sequence
  sense strand of an RNAi agent
  modified_base 1-19: /mod_base = "2'-hydroxy corresponding nucleoside"
agauaaugacacacguccat

SEQ ID NO: 346 - DNA, 20 bp, artificial sequence
  sense strand of an RNAi agent
  modified_base 1-19: /mod_base = "2'-hydroxy corresponding nucleoside"
gauaaugacacacguccaat

SEQ ID NO: 347 - DNA, 20 bp, artificial sequence
  sense strand of an RNAi agent
  modified_base 1-19: /mod_base = "2'-hydroxy corresponding nucleoside"
auaaugacacacguccauat

SEQ ID NO: 348 - DNA, 20 bp, artificial sequence
  sense strand of an RNAi agent
  modified_base 1-19: /mod_base = "2'-hydroxy corresponding nucleoside"
augacacacguccaugguat

SEQ ID NO: 349 - DNA, 20 bp, artificial sequence
  sense strand of an RNAi agent
  modified_base 1-19: /mod_base = "2'-hydroxy corresponding nucleoside"
gcgcguggugggcggacuat

SEQ ID NO: 350 - DNA, 20 bp, artificial sequence
  sense strand of an RNAi agent
  modified_base 1-19: /mod_base = "2'-hydroxy corresponding nucleoside"
cgcguggugggcggacuaat

SEQ ID NO: 351 - DNA, 20 bp, artificial sequence
  sense strand of an RNAi agent
  modified_base 1-19: /mod_base = "2'-hydroxy corresponding nucleoside"
gcguggugggcggacuagat

SEQ ID NO: 352 - DNA, 20 bp, artificial sequence
  sense strand of an RNAi agent
  modified_base 1-19: /mod_base = "2'-hydroxy corresponding nucleoside"
cguggugggcggacuaguat

SEQ ID NO: 353 - DNA, 20 bp, artificial sequence
  sense strand of an RNAi agent
  modified_base 1-19: /mod_base = "2'-hydroxy corresponding nucleoside"
ggcggacuaguggcucugat

SEQ ID NO: 354 - DNA, 20 bp, artificial sequence
  sense strand of an RNAi agent
  modified_base 1-19: /mod_base = "2'-hydroxy corresponding nucleoside"
ggccagcgcccgaggaacat

SEQ ID NO: 355 - DNA, 20 bp, artificial sequence
  sense strand of an RNAi agent
  modified_base 1-19: /mod_base = "2'-hydroxy corresponding nucleoside"
ggaacugacagugguacuat

SEQ ID NO: 356 - DNA, 20 bp, artificial sequence
  sense strand of an RNAi agent
  modified_base 1-19: /mod_base = "2'-hydroxy corresponding nucleoside"
agugguacuuggucaagaat

SEQ ID NO: 357 - DNA, 20 bp, artificial sequence
  sense strand of an RNAi agent
  modified_base 1-19: /mod_base = "2'-hydroxy corresponding nucleoside"
ugguacuuggucaagaucat

SEQ ID NO: 358 - DNA, 20 bp, artificial sequence
  sense strand of an RNAi agent
  modified_base 1-19: /mod_base = "2'-hydroxy corresponding nucleoside"
gguacuuggucaagaucgat

SEQ ID NO: 359 - DNA, 20 bp, artificial sequence
  sense strand of an RNAi agent
  modified_base 1-19: /mod_base = "2'-hydroxy corresponding nucleoside"
uacuuggucaagaucgccat

SEQ ID NO: 360 - DNA, 20 bp, artificial sequence
  sense strand of an RNAi agent
  modified_base 1-19: /mod_base = "2'-hydroxy corresponding nucleoside"
cuccuaccgccuucacgaat

SEQ ID NO: 361 - DNA, 20 bp, artificial sequence
  sense strand of an RNAi agent
  modified_base 1-19: /mod_base = "2'-hydroxy corresponding nucleoside"
ccuaccgccuucacgaggat

SEQ ID NO: 362 - DNA, 20 bp, artificial sequence
  sense strand of an RNAi agent
  modified_base 1-19: /mod_base = "2'-hydroxy corresponding nucleoside"
cuaccgccuucacgagggat

SEQ ID NO: 363 - DNA, 20 bp, artificial sequence
  sense strand of an RNAi agent
  modified_base 1-19: /mod_base = "2'-hydroxy corresponding nucleoside"
cugagacagugcucugcgat

SEQ ID NO: 364 - DNA, 20 bp, artificial sequence
  sense strand of an RNAi agent
  modified_base 1-19: /mod_base = "2'-hydroxy corresponding nucleoside"
aguucgagggggcugaagat

SEQ ID NO: 365 - DNA, 20 bp, artificial sequence
  sense strand of an RNAi agent
  modified_base 1-19: /mod_base = "2'-hydroxy corresponding nucleoside"
guucgagggggcugaagaat

SEQ ID NO: 366 - DNA, 20 bp, artificial sequence
  sense strand of an RNAi agent
  modified_base 1-19: /mod_base = "2'-hydroxy corresponding nucleoside"
ucgagggggcugaagaauat

SEQ ID NO: 367 - DNA, 20 bp, artificial sequence
  sense strand of an RNAi agent
  modified_base 1-19: /mod_base = "2'-hydroxy corresponding nucleoside"
cucuaacgugcacggagaat

SEQ ID NO: 368 - DNA, 20 bp, artificial sequence
  sense strand of an RNAi agent
  modified_base 1-19: /mod_base = "2'-hydroxy corresponding nucleoside"
cuaacgugcacggagacgat

SEQ ID NO: 369 - DNA, 20 bp, artificial sequence
  sense strand of an RNAi agent
  modified_base 1-19: /mod_base = "2'-hydroxy corresponding nucleoside"
acgugcacggagacgccaat

SEQ ID NO: 370 - DNA, 23 bp, artificial sequence
  sense strand of an RNAi agent
  modified_base 1-22: /mod_base = "2'-hydroxy corresponding nucleoside"
uauagcccaagaaagugaaagat

SEQ ID NO: 371 - DNA, 20 bp, artificial sequence
  sense strand of an RNAi agent
  modified_base 1-19: /mod_base = "2'-hydroxy corresponding nucleoside"
agcccaagaaagugaaagut

SEQ ID NO: 372 - DNA, 23 bp, artificial sequence
  sense strand of an RNAi agent
  modified_base 1-22: /mod_base = "2'-hydroxy corresponding nucleoside"
uaugcccaagaaagugaaagaat

SEQ ID NO: 373 - DNA, 23 bp, artificial sequence
  sense strand of an RNAi agent
  modified_base 1-22: /mod_base = "2'-hydroxy corresponding nucleoside"
uaucccaagaaagugaaagacat

SEQ ID NO: 374 - DNA, 23 bp, artificial sequence
  sense strand of an RNAi agent
  modified_base 1-22: /mod_base = "2'-hydroxy corresponding nucleoside"
uauccaagaaagugaaagaccat

SEQ ID NO: 375 - DNA, 20 bp, artificial sequence
  sense strand of an RNAi agent
  modified_base 1-19: /mod_base = "2'-hydroxy corresponding nucleoside"
ccaagaaagugaaagaccut

SEQ ID NO: 376 - DNA, 23 bp, artificial sequence
  sense strand of an RNAi agent
  modified_base 1-22: /mod_base = "2'-hydroxy corresponding nucleoside"
uaucaagaaagugaaagaccaat

SEQ ID NO: 377 - DNA, 23 bp, artificial sequence
  sense strand of an RNAi agent
  modified_base 1-22: /mod_base = "2'-hydroxy corresponding nucleoside"
uauuuugagccucagcuucucat

SEQ ID NO: 378 - RNA, 24 nt, artificial sequence
  sense strand of an RNAi agent
gcccaagaaagugaaagaccauau

SEQ ID NO: 379 - RNA, 26 nt, artificial sequence
  sense strand of an RNAi agent
uauaugcccaagaaagugaaagacca

SEQ ID NO: 380 - RNA, 22 nt, artificial sequence
  sense strand of an RNAi agent
ugcccaagaaagugaaagacca

SEQ ID NO: 381 - RNA, 21 nt, artificial sequence
  sense strand of an RNAi agent
gcccaagaaagugaaagacca

SEQ ID NO: 382 - RNA, 21 nt, artificial sequence
  sense strand of an RNAi agent
ggagcccaagaaagugaaaga

SEQ ID NO: 383 - RNA, 21 nt, artificial sequence
  sense strand of an RNAi agent
gagcccaagaaagugaaagaa

SEQ ID NO: 384 - RNA, 21 nt, artificial sequence
  sense strand of an RNAi agent
agcccaagaaagugaaagaca

SEQ ID NO: 385 - RNA, 21 nt, artificial sequence
  sense strand of an RNAi agent
cccaagaaagugaaagaccaa

SEQ ID NO: 386 - RNA, 21 nt, artificial sequence
  sense strand of an RNAi agent
gcuuugagccucagcuucuca

SEQ ID NO: 387 - RNA, 26 nt, artificial sequence
  sense strand of an RNAi agent
uauaugcuuugagccucagcuucuca

SEQ ID NO: 388 - RNA, 28 nt, artificial sequence
  sense strand of an RNAi agent
uauaugagcccaagaaagugaaagacca

SEQ ID NO: 389 - RNA, 28 nt, artificial sequence
  sense strand of an RNAi agent
uauaugugcuuugagccucagcuucuca

SEQ ID NO: 390 - RNA, 26 nt, artificial sequence
  sense strand of an RNAi agent
uauauguuuggagcccaagaaaguga

SEQ ID NO: 391 - RNA, 26 nt, artificial sequence
  sense strand of an RNAi agent
uauauuuuggagcccaagaaagugaa

SEQ ID NO: 392 - RNA, 26 nt, artificial sequence
  sense strand of an RNAi agent
uauauuuggagcccaagaaagugaaa

SEQ ID NO: 393 - RNA, 26 nt, artificial sequence
  sense strand of an RNAi agent
uauauuggagcccaagaaagugaaaa

SEQ ID NO: 394 - RNA, 26 nt, artificial sequence
  sense strand of an RNAi agent
uauauaagugcuuugagccucagcua

SEQ ID NO: 395 - RNA, 26 nt, artificial sequence
  sense strand of an RNAi agent
uauaugugcuuugagccucagcuuca

SEQ ID NO: 396 - RNA, 26 nt, artificial sequence
  sense strand of an RNAi agent
uauauggcuguggugaccgcaacaaa

SEQ ID NO: 397 - RNA, 26 nt, artificial sequence
  sense strand of an RNAi agent
uauaucuguggugaccgcaacaagca

SEQ ID NO: 398 - RNA, 26 nt, artificial sequence
  sense strand of an RNAi agent
uauauuguggugaccgcaacaagcca

SEQ ID NO: 399 - RNA, 26 nt, artificial sequence
  sense strand of an RNAi agent
uauuagcccaagaaagugaaagacca

SEQ ID NO: 400 - RNA, 26 nt, artificial sequence
  sense strand of an RNAi agent
uauaagcccaagaaagugaaagacca

SEQ ID NO: 401 - RNA, 26 nt, artificial sequence
  sense strand of an RNAi agent
auauugcccaagaaagugaaagacca

SEQ ID NO: 402 - RNA, 22 nt, artificial sequence
  sense strand of an RNAi agent
ccaagaaagugaaagaccauau

SEQ ID NO: 403 - RNA, 18 nt, artificial sequence
  sense strand of an RNAi agent
uggagcccaagaaaguga

SEQ ID NO: 404 - RNA, 18 nt, artificial sequence
  sense strand of an RNAi agent
ggagcccaagaaagugaa

SEQ ID NO: 405 - RNA, 18 nt, artificial sequence
  sense strand of an RNAi agent
gagcccaagaaagugaaa

SEQ ID NO: 406 - RNA, 18 nt, artificial sequence
  sense strand of an RNAi agent
agcccaagaaagugaaaa

SEQ ID NO: 407 - RNA, 18 nt, artificial sequence
  sense strand of an RNAi agent
gcccaagaaagugaaaga

SEQ ID NO: 408 - RNA, 18 nt, artificial sequence
  sense strand of an RNAi agent
cccaagaaagugaaagaa

SEQ ID NO: 409 - RNA, 18 nt, artificial sequence
  sense strand of an RNAi agent
ccaagaaagugaaagaca

SEQ ID NO: 410 - RNA, 18 nt, artificial sequence
  sense strand of an RNAi agent
caagaaagugaaagacca

SEQ ID NO: 411 - RNA, 18 nt, artificial sequence
  sense strand of an RNAi agent
aagaaagugaaagaccaa

SEQ ID NO: 412 - RNA, 18 nt, artificial sequence
  sense strand of an RNAi agent
ugcuuugagccucagcua

SEQ ID NO: 413 - RNA, 18 nt, artificial sequence
  sense strand of an RNAi agent
cuuugagccucagcuuca

SEQ ID NO: 414 - RNA, 18 nt, artificial sequence
  sense strand of an RNAi agent
uugagccucagcuucuca

SEQ ID NO: 415 - RNA, 18 nt, artificial sequence
  sense strand of an RNAi agent
uguggugaccgcaacaaa

SEQ ID NO: 416 - RNA, 18 nt, artificial sequence
  sense strand of an RNAi agent
guggugaccgcaacaaga

SEQ ID NO: 417 - RNA, 18 nt, artificial sequence
  sense strand of an RNAi agent
uggugaccgcaacaagca

SEQ ID NO: 418 - RNA, 18 nt, artificial sequence
  sense strand of an RNAi agent
ggugaccgcaacaagcca

SEQ ID NO: 419 - RNA, 17 nt, artificial sequence
  sense strand of an RNAi agent
ggagcccaagaaaguga

SEQ ID NO: 420 - RNA, 17 nt, artificial sequence
  sense strand of an RNAi agent
gagcccaagaaagugaa

SEQ ID NO: 421 - RNA, 17 nt, artificial sequence
  sense strand of an RNAi agent
agcccaagaaagugaaa

SEQ ID NO: 422 - RNA, 17 nt, artificial sequence
  sense strand of an RNAi agent
gcccaagaaagugaaaa

SEQ ID NO: 423 - RNA, 17 nt, artificial sequence
  sense strand of an RNAi agent
cccaagaaagugaaaga

SEQ ID NO: 424 - RNA, 17 nt, artificial sequence
  sense strand of an RNAi agent
ccaagaaagugaaagaa

SEQ ID NO: 425 - RNA, 17 nt, artificial sequence
  sense strand of an RNAi agent
caagaaagugaaagaca

SEQ ID NO: 426 - RNA, 17 nt, artificial sequence
  sense strand of an RNAi agent
aagaaagugaaagacca

SEQ ID NO: 427 - RNA, 17 nt, artificial sequence
  sense strand of an RNAi agent
agaaagugaaagaccaa

SEQ ID NO: 428 - RNA, 17 nt, artificial sequence
  sense strand of an RNAi agent
gcuuugagccucagcua

SEQ ID NO: 429 - RNA, 17 nt, artificial sequence
  sense strand of an RNAi agent
uuugagccucagcuuca

SEQ ID NO: 430 - RNA, 17 nt, artificial sequence
  sense strand of an RNAi agent
ugagccucagcuucuca

SEQ ID NO: 431 - RNA, 17 nt, artificial sequence
  sense strand of an RNAi agent
guggugaccgcaacaaa

SEQ ID NO: 432 - RNA, 17 nt, artificial sequence
  sense strand of an RNAi agent
uggugaccgcaacaaga

SEQ ID NO: 433 - RNA, 17 nt, artificial sequence
  sense strand of an RNAi agent
ggugaccgcaacaagca

SEQ ID NO: 434 - RNA, 17 nt, artificial sequence
  sense strand of an RNAi agent
gugaccgcaacaagcca

SEQ ID NO: 435 - RNA, 25 nt, artificial sequence
  sense strand of an RNAi agent
auaugcccaagaaagugaaagacca

SEQ ID NO: 436 - RNA, 24 nt, artificial sequence
  sense strand of an RNAi agent
uaugcccaagaaagugaaagacca

SEQ ID NO: 437 - RNA, 23 nt, artificial sequence
  sense strand of an RNAi agent
augcccaagaaagugaaagacca

SEQ ID NO: 438 - RNA, 26 nt, artificial sequence
  sense strand of an RNAi agent
uauaugcccaagaaagugaaagauau

SEQ ID NO: 439 - RNA, 25 nt, artificial sequence
  sense strand of an RNAi agent
uauaugcccaagaaagugaaagacc

SEQ ID NO: 440 - RNA, 26 nt, artificial sequence
  sense strand of an RNAi agent
uaugcccaagaaagugaaagaccuau

SEQ ID NO: 441 - RNA, 26 nt, artificial sequence
  sense strand of an RNAi agent
uaugcccaagaaagugaaagaccaau

SEQ ID NO: 442 - RNA, 26 nt, artificial sequence
  sense strand of an RNAi agent
uaugcccaagaaagugaaagaccauu

SEQ ID NO: 443 - RNA, 26 nt, artificial sequence
  sense strand of an RNAi agent
uaugcccaagaaagugaaagaccaua

SEQ ID NO: 444 - RNA, 26 nt, artificial sequence
  sense strand of an RNAi agent
uuagagcccaagaaagugaaagacca

SEQ ID NO: 445 - RNA, 26 nt, artificial sequence
  sense strand of an RNAi agent
uuauugcccaagaaagugaaagacca

SEQ ID NO: 446 - RNA, 26 nt, artificial sequence
  sense strand of an RNAi agent
uugaugcccaagaaagugaaagacca

SEQ ID NO: 447 - RNA, 26 nt, artificial sequence
  sense strand of an RNAi agent
uaugagcccaagaaagugaaagacca

SEQ ID NO: 448 - RNA, 26 nt, artificial sequence
  sense strand of an RNAi agent
auagagcccaagaaagugaaagacca

SEQ ID NO: 449 - RNA, 26 nt, artificial sequence
  sense strand of an RNAi agent
augcccaagaaagugaaagaccuauu

SEQ ID NO: 450 - RNA, 26 nt, artificial sequence
  sense strand of an RNAi agent
augcccaagaaagugaaagaccugau

SEQ ID NO: 451 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggugguagcacaccagggtt

SEQ ID NO: 452 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgggugguagcacaccaggtt

SEQ ID NO: 453 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggggugguagcacaccagtt

SEQ ID NO: 454 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcacuuucuugggcuccaatt

SEQ ID NO: 455 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucacuuucuugggcuccatt

SEQ ID NO: 456 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuucacuuucuugggcucctt

SEQ ID NO: 457 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuuucacuuucuugggcuctt

SEQ ID NO: 458 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcuuucacuuucuugggcutt

SEQ ID NO: 459 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucuuucacuuucuugggctt

SEQ ID NO: 460 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgucuuucacuuucuugggtt

SEQ ID NO: 461 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggucuuucacuuucuuggtt

SEQ ID NO: 462 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuggucuuucacuuucuugtt

SEQ ID NO: 463 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tagcugaggcucaaagcactt

SEQ ID NO: 464 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taagcugaggcucaaagcatt

SEQ ID NO: 465 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgaagcugaggcucaaagctt

SEQ ID NO: 466 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgagaagcugaggcucaaatt

SEQ ID NO: 467 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcaggccuggcuggccagtt

SEQ ID NO: 468 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcccccucgaacugguggtt

SEQ ID NO: 469 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuugcggucaccacagccctt

SEQ ID NO: 470 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguugcggucaccacagcctt

SEQ ID NO: 471 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuguugcggucaccacagctt

SEQ ID NO: 472 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuuguugcggucaccacagtt

SEQ ID NO: 473 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcuuguugcggucaccacatt

SEQ ID NO: 474 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcuuguugcggucaccactt

SEQ ID NO: 475 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggcuuguugcggucaccatt

SEQ ID NO: 476 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taagcacuuuauugaguuctt

SEQ ID NO: 477 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taaagcacuuuauugaguutt

SEQ ID NO: 478 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcaaagcacuuuauugagutt

SEQ ID NO: 479 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucaaagcacuuuauugagtt

SEQ ID NO: 480 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuucaaagcacuuuauugatt

SEQ ID NO: 481 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuuucaaagcacuuuauugtt

SEQ ID NO: 482 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuuuucaaagcacuuuauutt

SEQ ID NO: 483 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcauccguccguugguccatt

SEQ ID NO: 484 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcauccguccguuggucctt

SEQ ID NO: 485 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggcauccguccguugguctt

SEQ ID NO: 486 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuggcauccguccguuggutt

SEQ ID NO: 487 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tauggcauccguccguuggtt

SEQ ID NO: 488 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcauggcauccguccguugtt

SEQ ID NO: 489 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucauggcauccguccguutt

SEQ ID NO: 490 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcucauggcauccguccgutt

SEQ ID NO: 491 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcagagcccucauggcauctt

SEQ ID NO: 492 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcagagcccucauggcautt

SEQ ID NO: 493 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taccccaggagcagcagagtt

SEQ ID NO: 494 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgggaaguggcagggcucctt

SEQ ID NO: 495 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tugguacagcugccgguggtt

SEQ ID NO: 496 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcugguccugaucaaaguutt

SEQ ID NO: 497 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcugguccugaucaaagutt

SEQ ID NO: 498 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucgcugguccugaucaaatt

SEQ ID NO: 499 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccaucgcugguccugauctt

SEQ ID NO: 500 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcccaucgcugguccugautt

SEQ ID NO: 501 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuccccaucgcugguccugtt

SEQ ID NO: 502 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcuuucuugggcuccaaactt

SEQ ID NO: 503 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacuuucuugggcuccaaatt

SEQ ID NO: 504 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcugagcccgcggccaucatt

SEQ ID NO: 505 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuccgaggcccacggcugatt

SEQ ID NO: 506 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcuccgaggcccacggcugtt

SEQ ID NO: 507 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccuccgaggcccacggcutt

SEQ ID NO: 508 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgguggccuccgaggcccatt

SEQ ID NO: 509 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tagguggccuccgaggccctt

SEQ ID NO: 510 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuagguggccuccgaggcctt

SEQ ID NO: 511 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguagguggccuccgaggctt

SEQ ID NO: 512 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguccccaguuccgcgcuutt

SEQ ID NO: 513 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuuccggcagaaggcguggtt

SEQ ID NO: 514 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguuccggcagaaggcgugtt

SEQ ID NO: 515 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgguuccggcagaaggcgutt

SEQ ID NO: 516 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccggguuccggcagaaggtt

SEQ ID NO: 517 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuccggguuccggcagaagtt

SEQ ID NO: 518 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguccggguuccggcagaatt

SEQ ID NO: 519 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuguccggguuccggcagatt

SEQ ID NO: 520 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcguuguccggguuccggctt

SEQ ID NO: 521 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucguuguccggguuccggtt

SEQ ID NO: 522 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuuccuggucagggaaggctt

SEQ ID NO: 523 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguuccuggucagggaaggtt

SEQ ID NO: 524 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcguuccuggucagggaagtt

SEQ ID NO: 525 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccguuccuggucagggaatt

SEQ ID NO: 526 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgccguuccuggucagggatt

SEQ ID NO: 527 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcagugggccguuccuggutt

SEQ ID NO: 528 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tagcucagugggccguucctt

SEQ ID NO: 529 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgaagacagacucuugcggtt

SEQ ID NO: 530 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tugccggcgcagaaacugutt

SEQ ID NO: 531 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggcgaugaggcugccggctt

SEQ ID NO: 532 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgggcgaugaggcugccggtt

SEQ ID NO: 533 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggggcgaugaggcugccgtt

SEQ ID NO: 534 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacccagcagggggcgaugtt

SEQ ID NO: 535 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcacccagcagggggcgatt

SEQ ID NO: 536 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tagcacccagcagggggcgtt

SEQ ID NO: 537 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucagcacccagcagggggtt

SEQ ID NO: 538 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccgagcaccaccgucagatt

SEQ ID NO: 539 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggccgagcaccaccgucatt

SEQ ID NO: 540 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuggccgagcaccaccguctt

SEQ ID NO: 541 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuccuggccgagcaccacctt

SEQ ID NO: 542 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcagcugccguccgcaucctt

SEQ ID NO: 543 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggagcgcgcagcugccgutt

SEQ ID NO: 544 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacguaaggcgacaggagctt

SEQ ID NO: 545 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcugaacguaaggcgacagtt

SEQ ID NO: 546 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcuggcauauuccuccgcctt

SEQ ID NO: 547 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tagcuggcauauuccuccgtt

SEQ ID NO: 548 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgaagcuggcauauuccuctt

SEQ ID NO: 549 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggaagcuggcauauuccutt

SEQ ID NO: 550 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgggccuccggaaucacctt

SEQ ID NO: 551 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgccacucucucacugcggtt

SEQ ID NO: 552 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tagccacucucucacugcgtt

SEQ ID NO: 553 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taacagagccgucauggcgtt

SEQ ID NO: 554 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcaacagagccgucauggctt

SEQ ID NO: 555 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacaacagagccgucauggtt

SEQ ID NO: 556 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taacaacagagccgucaugtt

SEQ ID NO: 557 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgaacaacagagccgucautt

SEQ ID NO: 558 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggaacaacagagccgucatt

SEQ ID NO: 559 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcggugguacugaaagggatt

SEQ ID NO: 560 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuuguggaugcauuuguggtt

SEQ ID NO: 561 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcaagcaguauccccauugtt

SEQ ID NO: 562 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcuccaagcaguauccccatt

SEQ ID NO: 563 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcuccaagcaguaucccctt

SEQ ID NO: 564 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgggcuccaagcaguaucctt

SEQ ID NO: 565 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguguuugcugcaaugguctt

SEQ ID NO: 566 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuuccgguagguggccucctt

SEQ ID NO: 567 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguuccgguagguggccuctt

SEQ ID NO: 568 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuguuccgguagguggccutt

SEQ ID NO: 569 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcucagucauguuccgguatt

SEQ ID NO: 570 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgacgugugucauuaucugtt

SEQ ID NO: 571 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggacgugugucauuaucutt

SEQ ID NO: 572 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuggacgugugucauuauctt

SEQ ID NO: 573 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tauggacgugugucauuautt

SEQ ID NO: 574 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taccauggacgugugucautt

SEQ ID NO: 575 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taguccgcccaccacgcgctt

SEQ ID NO: 576 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuaguccgcccaccacgcgtt

SEQ ID NO: 577 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcuaguccgcccaccacgctt

SEQ ID NO: 578 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacuaguccgcccaccacgtt

SEQ ID NO: 579 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcagagccacuaguccgcctt

SEQ ID NO: 580 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguuccucgggcgcuggcctt

SEQ ID NO: 581 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taguaccacugucaguucctt

SEQ ID NO: 582 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucuugaccaaguaccacutt

SEQ ID NO: 583 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgaucuugaccaaguaccatt

SEQ ID NO: 584 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgaucuugaccaaguacctt

SEQ ID NO: 585 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgaucuugaccaaguacctt

SEQ ID NO: 586 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucgugaaggcgguaggagtt

SEQ ID NO: 587 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccucgugaaggcgguaggtt

SEQ ID NO: 588 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcccucgugaaggcgguagtt

SEQ ID NO: 589 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgcagagcacugucucagtt

SEQ ID NO: 590 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcuucagcccccucgaacutt

SEQ ID NO: 591 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucuucagcccccucgaactt

SEQ ID NO: 592 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tauucuucagcccccucgatt

SEQ ID NO: 593 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucuccgugcacguuagagtt

SEQ ID NO: 594 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgucuccgugcacguuagtt

SEQ ID NO: 595 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuggcgucuccgugcacgutt

SEQ ID NO: 596 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
acuuucacuuucuugggcutt

SEQ ID NO: 597 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcuuucacuuucuugggcutt

SEQ ID NO: 598 - DNA, 21 bp, artificial sequence
  antisense strand of an RNAi agent
  modified_base 7: /mod_base = "2'-3' seco corresponding nucleotide"
  modified_base 2,4,6,8,10,12,14,16,18: /mod_base = "2'-deoxy-2'-fluoro corresponding nucleoside"
  modified_base 3,5,9,11,13,15,17,19: /mod_base = "2'-O-methyl corresponding nucleoside"
  modified_base 21: /mod_base = "5'-phosphorothioate corresponding nucleotide"
tcuuucacuuucuugggcutt

SEQ ID NO: 599 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucuuucacuuucuugggctt

SEQ ID NO: 600 - DNA, 21 bp, artificial sequence
  antisense strand of an RNAi agent
  modified_base 7: /mod_base = "2'-3' seco corresponding nucleotide"
  modified_base 2,4,6,8,10,12,14,16,18: /mod_base = "2'-deoxy-2'-fluoro corresponding nucleoside"
  modified_base 3,5,9,11,13,15,17,19: /mod_base = "2'-O-methyl corresponding nucleoside"
  modified_base 21: /mod_base = "5'-phosphorothioate corresponding nucleotide"
tucuuucacuuucuugggctt

SEQ ID NO: 601 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgucuuucacuuucuugggtt

SEQ ID NO: 602 - DNA, 21 bp, artificial sequence
  antisense strand of an RNAi agent
  modified_base 7: /mod_base = "2'-3' seco corresponding nucleotide"
  modified_base 2,4,6,8,10,12,14,16,18: /mod_base = "2'-deoxy-2'-fluoro corresponding nucleoside"
  modified_base 3,5,9,11,13,15,17,19: /mod_base = "2'-O-methyl corresponding nucleoside"
  modified_base 21: /mod_base = "5'-phosphorothioate corresponding nucleotide"
tgucuuucacuuucuugggtt

SEQ ID NO: 603 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
aggucuuucacuuucuuggtt

SEQ ID NO: 604 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggucuuucacuuucuuggtt

SEQ ID NO: 605 - DNA, 21 bp, artificial sequence
  antisense strand of an RNAi agent
  modified_base 7: /mod_base = "2'-3' seco corresponding nucleotide"
  modified_base 2,4,6,8,10,12,14,16,18: /mod_base = "2'-deoxy-2'-fluoro corresponding nucleoside"
  modified_base 3,5,9,11,13,15,17,19: /mod_base = "2'-O-methyl corresponding nucleoside"
  modified_base 21: /mod_base = "5'-phosphorothioate corresponding nucleotide"
tggucuuucacuuucuuggtt

SEQ ID NO: 606 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuggucuuucacuuucuugtt

SEQ ID NO: 607 - DNA, 21 bp, artificial sequence
  antisense strand of an RNAi agent
  modified_base 7: /mod_base = "2'-3' seco corresponding nucleotide"
  modified_base 2,4,6,8,10,12,14,16,18: /mod_base = "2'-deoxy-2'-fluoro corresponding nucleoside"
  modified_base 3,5,9,11,13,15,17,19: /mod_base = "2'-O-methyl corresponding nucleoside"
  modified_base 21: /mod_base = "5'-phosphorothioate corresponding nucleotide"
tuggucuuucacuuucuugtt

SEQ ID NO: 608 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgagaagcugaggcucaaatt

SEQ ID NO: 609 - DNA, 21 bp, artificial sequence
  antisense strand of an RNAi agent
  modified_base 7: /mod_base = "2'-3' seco corresponding nucleotide"
  modified_base 2,4,6,8,10,12,14,16,18: /mod_base = "2'-deoxy-2'-fluoro corresponding nucleoside"
  modified_base 3,5,9,11,13,15,17,19: /mod_base = "2'-O-methyl corresponding nucleoside"
  modified_base 21: /mod_base = "5'-phosphorothioate corresponding nucleotide"
tgagaagcugaggcucaaatt

SEQ ID NO: 610 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 1: /mod_base = "5'-vinyl phosphonate nucleotide"
  modified_base 21: /mod_base = "5'-phosphorothioate corresponding nucleotide"
tgucuuucacuuucuugggtt

SEQ ID NO: 611 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 1: /mod_base = "5'-vinyl phosphonate nucleotide"
  modified_base 20,21: /mod_base = "5'-phosphorothioate corresponding nucleotide"
tgucuuucacuuucuugggtt

SEQ ID NO: 612 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 1: /mod_base = "5'-vinyl phosphonate nucleotide"
  modified_base 21: /mod_base = "5'-phosphorothioate corresponding nucleotide"
tggucuuucacuuucuuggtt

SEQ ID NO: 613 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 1: /mod_base = "5'-vinyl phosphonate nucleotide"
  modified_base 20,21: /mod_base = "5'-phosphorothioate corresponding nucleotide"
tggucuuucacuuucuuggtt

SEQ ID NO: 614 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 1: /mod_base = "5'-vinyl phosphonate nucleotide"
  modified_base 21: /mod_base = "5'-phosphorothioate corresponding nucleotide"
tgagaagcugaggcucaaatt

SEQ ID NO: 615 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 1: /mod_base = "5'-vinyl phosphonate nucleotide"
  modified_base 20,21: /mod_base = "5'-phosphorothioate corresponding nucleotide"
tgagaagcugaggcucaaatt

SEQ ID NO: 616 - DNA, 21 bp, artificial sequence
  antisense strand of an RNAi agent
  modified_base 7: /mod_base = "2'-3' seco corresponding nucleotide"
  modified_base 2,4,6,8,10,12,14,16,18: /mod_base = "2'-deoxy-2'-fluoro corresponding nucleoside"
  modified_base 3,5,9,11,13,15,17,19: /mod_base = "2'-O-methyl corresponding nucleoside"
  modified_base 1: /mod_base = "5'-vinyl phosphonate nucleotide"
  modified_base 21: /mod_base = "5'-phosphorothioate corresponding nucleotide"
tggucuuucacuuucuuggtt

SEQ ID NO: 617 - DNA, 21 bp, artificial sequence
  antisense strand of an RNAi agent
  modified_base 7: /mod_base = "2'-3' seco corresponding nucleotide"
  modified_base 2,4,6,8,10,12,14,16,18: /mod_base = "2'-deoxy-2'-fluoro corresponding nucleoside"
  modified_base 3,5,9,11,13,15,17,19: /mod_base = "2'-O-methyl corresponding nucleoside"
  modified_base 1: /mod_base = "5'-vinyl phosphonate nucleotide"
  modified_base 20,21: /mod_base = "5'-phosphorothioate corresponding nucleotide"
tggucuuucacuuucuuggtt

SEQ ID NO: 618 - DNA, 21 bp, artificial sequence
  antisense strand of an RNAi agent
  modified_base 7: /mod_base = "2'-3' seco corresponding nucleotide"
  modified_base 2,4,6,8,10,12,14,16,18: /mod_base = "2'-deoxy-2'-fluoro corresponding nucleoside"
  modified_base 3,5,9,11,13,15,17,19: /mod_base = "2'-O-methyl corresponding nucleoside"
  modified_base 2,3,20,21: /mod_base = "5'-phosphorothioate corresponding nucleotide"
tggucuuucacuuucuuggtt

SEQ ID NO: 619 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 2,3,20,21: /mod_base = "5'-phosphorothioate corresponding nucleotide"
tgucuuucacuuucuugggtt

SEQ ID NO: 620 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 2,3,20,21: /mod_base = "5'-phosphorothioate corresponding nucleotide"
tggucuuucacuuucuuggtt

SEQ ID NO: 621 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 2,3,20,21: /mod_base = "5'-phosphorothioate corresponding nucleotide"
tgagaagcugaggcucaaatt

SEQ ID NO: 622 - DNA, 21 bp, artificial sequence
  antisense strand of an RNAi agent
  modified_base 6: /mod_base = "2'-3' seco corresponding nucleotide"
  modified_base 2,4,8,10,14,16,18: /mod_base = "2'-deoxy-2'-fluoro corresponding nucleoside"
  modified_base 3,5,7,9,11,12,13,15,17,19: /mod_base = "2'-O-methyl corresponding nucleoside"
  modified_base 2,3,20,21: /mod_base = "5'-phosphorothioate corresponding nucleotide"
tgucuuucacuuucuugggtt

SEQ ID NO: 623 - DNA, 21 bp, artificial sequence
  antisense strand of an RNAi agent
  modified_base 6: /mod_base = "2'-3' seco corresponding nucleotide"
  modified_base 2,4,8,10,14,16,18: /mod_base = "2'-deoxy-2'-fluoro corresponding nucleoside"
  modified_base 3,5,7,9,11,12,13,15,17,19: /mod_base = "2'-O-methyl corresponding nucleoside"
  modified_base 2,3,20,21: /mod_base = "5'-phosphorothioate corresponding nucleotide"
tggucuuucacuuucuuggtt

SEQ ID NO: 624 - DNA, 21 bp, artificial sequence
  antisense strand of an RNAi agent
  modified_base 6: /mod_base = "2'-3' seco corresponding nucleotide"
  modified_base 2,4,8,10,14,16,18: /mod_base = "2'-deoxy-2'-fluoro corresponding nucleoside"
  modified_base 3,5,7,9,11,12,13,15,17,19: /mod_base = "2'-O-methyl corresponding nucleoside"
  modified_base 2,3,20,21: /mod_base = "5'-phosphorothioate corresponding nucleotide"
tgagaagcugaggcucaaatt

SEQ ID NO: 625 - DNA, 21 bp, artificial sequence
  antisense strand of an RNAi agent
  modified_base 7: /mod_base = "2'-3' seco corresponding nucleotide"
  modified_base 2,4,6,8,10,14,16,18: /mod_base = "2'-deoxy-2'-fluoro corresponding nucleoside"
  modified_base 3,5,9,11,12,13,15,17,19: /mod_base = "2'-O-methyl corresponding nucleoside"
  modified_base 2,3,20,21: /mod_base = "5'-phosphorothioate corresponding nucleotide"
tggucuuucacuuucuuggtt

SEQ ID NO: 626 - DNA, 21 bp, artificial sequence
  antisense strand of an RNAi agent
  modified_base 7: /mod_base = "2'-3' seco corresponding nucleotide"
  modified_base 2,4,6,8,10,14,16,18: /mod_base = "2'-deoxy-2'-fluoro corresponding nucleoside"
  modified_base 1,3,5,9,11,12,13,15,17,19: /mod_base = "2'-O-methyl corresponding nucleoside"
  modified_base 2,3,20,21: /mod_base = "5'-phosphorothioate corresponding nucleotide"
uggucuuucacuuucuuggtt

SEQ ID NO: 627 - DNA, 21 bp, artificial sequence
  antisense strand of an RNAi agent
  modified_base 6: /mod_base = "2'-3' seco corresponding nucleotide"
  modified_base 2,4,8,10,14,16,18: /mod_base = "2'-deoxy-2'-fluoro corresponding nucleoside"
  modified_base 1,3,5,7,9,11,12,13,15,17,19: /mod_base = "2'-O-methyl corresponding nucleoside"
  modified_base 2,3,20,21: /mod_base = "5'-phosphorothioate corresponding nucleotide"
uggucuuucacuuucuuggtt

SEQ ID NO: 628 - DNA, 23 bp, artificial sequence
  antisense strand of an RNAi agent
  modified_base 6: /mod_base = "2'-3' seco corresponding nucleotide"
  modified_base 2,4,8,10,14,16,18,20: /mod_base = "2'-deoxy-2'-fluoro corresponding nucleoside"
  modified_base 1,3,5,7,9,11,12,13,15,17,19,21,22,23: /mod_base = "2'-O-methyl corresponding nucleoside"
  modified_base 2,3,22,23: /mod_base = "5'-phosphorothioate corresponding nucleotide"
uggucuuucacuuucuugggcuc

SEQ ID NO: 629 - DNA, 23 bp, artificial sequence
  antisense strand of an RNAi agent
  modified_base 7: /mod_base = "2'-3' seco corresponding nucleotide"
  modified_base 2,4,6,8,10,14,16,18,20: /mod_base = "2'-deoxy-2'-fluoro corresponding nucleoside"
  modified_base 1,3,5,9,11,12,13,15,17,19,21,22,23: /mod_base = "2'-O-methyl corresponding nucleoside"
  modified_base 2,3,22,23: /mod_base = "5'-phosphorothioate corresponding nucleotide"
uggucuuucacuuucuugggcuc

SEQ ID NO: 630 - DNA, 21 bp, artificial sequence
  antisense strand of an RNAi agent
  modified_base 6: /mod_base = "2'-3' seco corresponding nucleotide"
  modified_base 2,4,8,10,14,16,18: /mod_base = "2'-deoxy-2'-fluoro corresponding nucleoside"
  modified_base 3,5,7,9,11,12,13,15,17,19: /mod_base = "2'-O-methyl corresponding nucleoside"
  modified_base 21: /mod_base = "5'-phosphorothioate corresponding nucleotide"
tggucuuucacuuucuuggtt

SEQ ID NO: 631 - DNA, 21 bp, artificial sequence
  antisense strand of an RNAi agent
  modified_base 7: /mod_base = "2'-3' seco corresponding nucleotide"
  modified_base 2,4,6,8,10,14,16,18: /mod_base = "2'-deoxy-2'-fluoro corresponding nucleoside"
  modified_base 3,5,9,11,12,13,15,17,19: /mod_base = "2'-O-methyl corresponding nucleoside"
  modified_base 21: /mod_base = "5'-phosphorothioate corresponding nucleotide"
tggucuuucacuuucuuggtt

SEQ ID NO: 632 - DNA, 21 bp, artificial sequence
  antisense strand of an RNAi agent
  modified_base 6: /mod_base = "2'-3' seco corresponding nucleotide"
  modified_base 2,4,8,10,14,16,18: /mod_base = "2'-deoxy-2'-fluoro corresponding nucleoside"
  modified_base 3,5,7,9,11,12,13,15,17,19: /mod_base = "2'-O-methyl corresponding nucleoside"
  modified_base 21: /mod_base = "5'-phosphorothioate corresponding nucleotide"
tgucuuucacuuucuugggtt

SEQ ID NO: 633 - DNA, 21 bp, artificial sequence
  antisense strand of an RNAi agent
  modified_base 6: /mod_base = "2'-3' seco corresponding nucleotide"
  modified_base 2,4,8,10,14,16,18: /mod_base = "2'-deoxy-2'-fluoro corresponding nucleoside"
  modified_base 3,5,7,9,11,12,13,15,17,19: /mod_base = "2'-O-methyl corresponding nucleoside"
  modified_base 21: /mod_base = "5'-phosphorothioate corresponding nucleotide"
tgagaagcugaggcucaaatt

SEQ ID NO: 634 - DNA, 21 bp, artificial sequence
  antisense strand of an RNAi agent
  modified_base 1: modified_base = "5'-phosphate nucleotide"
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggucuuucacuuucuuggtt

SEQ ID NO: 635 - DNA, 21 bp, artificial sequence
  antisense strand of an RNAi agent
  modified_base 1: modified_base = "5'-phosphate nucleotide"
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggucuuucacuuucuuggtt

SEQ ID NO: 636 - DNA, 26 bp, artificial sequence
  antisense strand of an RNAi agent
  modified_base 25: /mod_base = "2'-hydroxy corresponding nucleoside"
  modified_base 6: /mod_base = "2'-3' seco corresponding nucleotide"
  modified_base 2,4,8,10,14,16,18,20: /mod_base = "2'-deoxy-2'-fluoro corresponding nucleoside"
  modified_base 3,5,7,9,11,12,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 637 - DNA, 26 bp, artificial sequence
  antisense strand of an RNAi agent
  modified_base 25: /mod_base = "2'-hydroxy corresponding nucleoside"
  modified_base 2,4,6,8,10,14,16,18,20: /mod_base = "2'-deoxy-2'-fluoro corresponding nucleoside"
  modified_base 3,5,7,9,11,12,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 638 - DNA, 26 bp, artificial sequence
  antisense strand of an RNAi agent
  modified_base 6: /mod_base = "2'-3' seco corresponding nucleotide"
  modified_base 2,4,8,10,14,16,18,20: /mod_base = "2'-deoxy-2'-fluoro corresponding nucleoside"
  modified_base 3,5,7,9,11,12,13,15,17,19,21,22,23,24: /mod_base = "2'-O-methyl corresponding nucleoside"
  modified_base 2,3,25,26: /mod_base = "5'-phosphorothioate corresponding nucleotide"
tggucuuucacuuucuugggcucutt

SEQ ID NO: 639 - DNA, 26 bp, artificial sequence
  antisense strand of an RNAi agent
  modified_base 2,4,6,8,10,14,16,18,20: /mod_base = "2'-deoxy-2'-fluoro corresponding nucleoside"
  modified_base 3,5,7,9,11,12,13,15,17,19,21,22,23,24: /mod_base = "2'-O-methyl corresponding nucleoside"
  modified_base 2,3,25,26: /mod_base = "5'-phosphorothioate corresponding nucleotide"
tggucuuucacuuucuugggcucutt

SEQ ID NO: 640 - DNA, 24 bp, artificial sequence
  antisense strand of an RNAi agent
  modified_base 2,4,6,8,10,14,16,18,20: /mod_base = "2'-deoxy-2'-fluoro corresponding nucleoside"
  modified_base 3,5,7,9,11,12,13,15,17,19,21,22,23,24: /mod_base = "2'-O-methyl corresponding nucleoside"
  modified_base 2,3,23,24: /mod_base = "5'-phosphorothioate corresponding nucleotide"
tggucuuucacuuucuugggcucu

SEQ ID NO: 641 - DNA, 23 bp, artificial sequence
  antisense strand of an RNAi agent
  modified_base 2,4,6,8,10,14,16,18,20: /mod_base = "2'-deoxy-2'-fluoro corresponding nucleoside"
  modified_base 3,5,7,9,11,12,13,15,17,19,21,22,23: /mod_base = "2'-O-methyl corresponding nucleoside"
  modified_base 2,3,22,23: /mod_base = "5'-phosphorothioate corresponding nucleotide"
tggucuuucacuuucuugggcuc

SEQ ID NO: 642 - DNA, 23 bp, artificial sequence
  antisense strand of an RNAi agent
  modified_base 2,4,6,8,10,14,16,18,20: /mod_base = "2'-deoxy-2'-fluoro corresponding nucleoside"
  modified_base 3,5,7,9,11,12,13,15,17,19,21,22,23: /mod_base = "2'-O-methyl corresponding nucleoside"
  modified_base 2,3,22,23: /mod_base = "5'-phosphorothioate corresponding nucleotide"
tcuuucacuuucuugggcuccaa

SEQ ID NO: 643 - DNA, 23 bp, artificial sequence
  antisense strand of an RNAi agent
  modified_base 2,4,6,8,10,14,16,18,20: /mod_base = "2'-deoxy-2'-fluoro corresponding nucleoside"
  modified_base 3,5,7,9,11,12,13,15,17,19,21,22,23: /mod_base = "2'-O-methyl corresponding nucleoside"
  modified_base 2,3,22,23: /mod_base = "5'-phosphorothioate corresponding nucleotide"
tucuuucacuuucuugggcucca

SEQ ID NO: 644 - DNA, 23 bp, artificial sequence
  antisense strand of an RNAi agent
  modified_base 2,4,6,8,10,14,16,18,20: /mod_base = "2'-deoxy-2'-fluoro corresponding nucleoside"
  modified_base 3,5,7,9,11,12,13,15,17,19,21,22,23: /mod_base = "2'-O-methyl corresponding nucleoside"
  modified_base 2,3,22,23: /mod_base = "5'-phosphorothioate corresponding nucleotide"
tgucuuucacuuucuugggcucc

SEQ ID NO: 645 - DNA, 23 bp, artificial sequence
  antisense strand of an RNAi agent
  modified_base 2,4,6,8,10,14,16,18,20: /mod_base = "2'-deoxy-2'-fluoro corresponding nucleoside"
  modified_base 3,5,7,9,11,12,13,15,17,19,21,22,23: /mod_base = "2'-O-methyl corresponding nucleoside"
  modified_base 2,3,22,23: /mod_base = "5'-phosphorothioate corresponding nucleotide"
tuggucuuucacuuucuugggcu

SEQ ID NO: 646 - DNA, 23 bp, artificial sequence
  antisense strand of an RNAi agent
  modified_base 2,4,6,8,10,14,16,18,20: /mod_base = "2'-deoxy-2'-fluoro corresponding nucleoside"
  modified_base 3,5,7,9,11,12,13,15,17,19,21,22,23: /mod_base = "2'-O-methyl corresponding nucleoside"
  modified_base 2,3,22,23: /mod_base = "5'-phosphorothioate corresponding nucleotide"
tgagaagcugaggcucaaagcac

SEQ ID NO: 647 - DNA, 26 bp, artificial sequence
  antisense strand of an RNAi agent
  modified_base 25: /mod_base = "2'-hydroxy corresponding nucleoside"
  modified_base 2,4,6,8,10,14,16,18,20: /mod_base = "2'-deoxy-2'-fluoro corresponding nucleoside"
  modified_base 3,5,7,9,11,12,13,15,17,19,21,22,23,24,26: /mod_base = "2'-O-methyl corresponding nucleoside"
  modified_base 2,3,22,23: /mod_base = "5'-phosphorothioate corresponding nucleotide"
tggucuuucacuuucuugggcucuau

SEQ ID NO: 648 - DNA, 26 bp, artificial sequence
  antisense strand of an RNAi agent
  modified_base 25: /mod_base = "2'-hydroxy corresponding nucleoside"
  modified_base 6: /mod_base = "2'-3' seco corresponding nucleotide"
  modified_base 2,4,8,10,12,14,16,18,20: /mod_base = "2'-deoxy-2'-fluoro corresponding nucleoside"
  modified_base 3,5,7,9,11,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 649 - DNA, 26 bp, artificial sequence
  antisense strand of an RNAi agent
  modified_base 25: /mod_base = "2'-hydroxy corresponding nucleoside"
  modified_base 7: /mod_base = "2'-3' seco corresponding nucleotide"
  modified_base 2,4,6,8,10,12,14,16,18,20: /mod_base = "2'-deoxy-2'-fluoro corresponding nucleoside"
  modified_base 3,5,9,11,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 650 - DNA, 26 bp, artificial sequence
  antisense strand of an RNAi agent
  modified_base 25: /mod_base = "2'-hydroxy corresponding nucleoside"
  modified_base 8: /mod_base = "2'-3' seco corresponding nucleotide"
  modified_base 2,4,6,10,12,14,16,18,20: /mod_base = "2'-deoxy-2'-fluoro corresponding nucleoside"
  modified_base 3,5,7,9,11,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 651 - DNA, 26 bp, artificial sequence
  antisense strand of an RNAi agent
  modified_base 25: /mod_base = "2'-hydroxy corresponding nucleoside"
  modified_base 9: /mod_base = "2'-3' seco corresponding nucleotide"
  modified_base 2,4,6,8,10,12,14,16,18,20: /mod_base = "2'-deoxy-2'-fluoro corresponding nucleoside"
  modified_base 3,5,7,11,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 652 - DNA, 26 bp, artificial sequence
  antisense strand of an RNAi agent
  modified_base 25: /mod_base = "2'-hydroxy corresponding nucleoside"
  modified_base 10: /mod_base = "2'-3' seco corresponding nucleotide"
  modified_base 2,4,6,8,12,14,16,18,20: /mod_base = "2'-deoxy-2'-fluoro corresponding nucleoside"
  modified_base 3,5,7,9,11,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 653 - DNA, 26 bp, artificial sequence
  antisense strand of an RNAi agent
  modified_base 25: /mod_base = "2'-hydroxy corresponding nucleoside"
  modified_base 11: /mod_base = "2'-3' seco corresponding nucleotide"
  modified_base 2,4,6,8,10,12,14,16,18,20: /mod_base = "2'-deoxy-2'-fluoro corresponding nucleoside"
  modified_base 3,5,7,9,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 654 - DNA, 26 bp, artificial sequence
  antisense strand of an RNAi agent
  modified_base 25: /mod_base = "2'-hydroxy corresponding nucleoside"
  modified_base 12: /mod_base = "2'-3' seco corresponding nucleotide"
  modified_base 2,4,6,8,10,14,16,18,20: /mod_base = "2'-deoxy-2'-fluoro corresponding nucleoside"
  modified_base 3,5,7,9,11,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 655 - DNA, 26 bp, artificial sequence
  antisense strand of an RNAi agent
  modified_base 25: /mod_base = "2'-hydroxy corresponding nucleoside"
  modified_base 13: /mod_base = "2'-3' seco corresponding nucleotide"
  modified_base 2,4,6,8,10,12,14,16,18,20: /mod_base = "2'-deoxy-2'-fluoro corresponding nucleoside"
  modified_base 3,5,7,9,11,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 656 - DNA, 26 bp, artificial sequence
  antisense strand of an RNAi agent
  modified_base 25: /mod_base = "2'-hydroxy corresponding nucleoside"
  modified_base 14: /mod_base = "2'-3' seco corresponding nucleotide"
  modified_base 2,4,6,8,10,12,16,18,20: /mod_base = "2'-deoxy-2'-fluoro corresponding nucleoside"
  modified_base 3,5,7,9,11,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 657 - DNA, 26 bp, artificial sequence
  antisense strand of an RNAi agent
  modified_base 25: /mod_base = "2'-hydroxy corresponding nucleoside"
  modified_base 15: /mod_base = "2'-3' seco corresponding nucleotide"
  modified_base 2,4,6,8,10,12,14,16,18,20: /mod_base = "2'-deoxy-2'-fluoro corresponding nucleoside"
  modified_base 3,5,7,9,11,13,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 658 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20: /mod_base = "2'-deoxy-2'-fluoro corresponding nucleoside"
  modified_base 3,5,7,9,11,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 659 - DNA, 26 bp, artificial sequence
  antisense strand of an RNAi agent
  modified_base 25: /mod_base = "2'-hydroxy corresponding nucleoside"
  modified_base 2,4,6,8,10,13,14,16,18,20: /mod_base = "2'-deoxy-2'-fluoro corresponding nucleoside"
  modified_base 3,5,7,9,11,12,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 660 - DNA, 26 bp, artificial sequence
  antisense strand of an RNAi agent
  modified_base 25: /mod_base = "2'-hydroxy corresponding nucleoside"
  modified_base 2,4,6,8,10,13,16,18,20: /mod_base = "2'-deoxy-2'-fluoro corresponding nucleoside"
  modified_base 3,5,7,9,11,12,14,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 661 - DNA, 26 bp, artificial sequence
  antisense strand of an RNAi agent
  modified_base 25: /mod_base = "2'-hydroxy corresponding nucleoside"
  modified_base 2,4,6,8,10,12,13,15,17,19,21,23: /mod_base = "2'-deoxy-2'-fluoro corresponding nucleoside"
  modified_base 3,5,7,9,11,14,16,18,20,22,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 662 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20: /mod_base = "2'-deoxy-2'-fluoro corresponding nucleoside"
  modified_base 3,5,7,9,11,13,15,17,19,21,22,23,24,26: /mod_base = "2'-O-methyl corresponding nucleoside"
  modified_base 2,3,23,24: /mod_base = "5'-phosphorothioate corresponding nucleotide"
tgagaagcugaggcucaaagcacuau

SEQ ID NO: 663 - DNA, 26 bp, artificial sequence
  antisense strand of an RNAi agent
  modified_base 25: /mod_base = "2'-hydroxy corresponding nucleoside"
  modified_base 2,4,6,8,10,13,14,16,18,20: /mod_base = "2'-deoxy-2'-fluoro corresponding nucleoside"
  modified_base 3,5,7,9,11,12,15,17,19,21,22,23,24,26: /mod_base = "2'-O-methyl corresponding nucleoside"
  modified_base 2,3,23,24: /mod_base = "5'-phosphorothioate corresponding nucleotide"
tgagaagcugaggcucaaagcacuau

SEQ ID NO: 664 - DNA, 26 bp, artificial sequence
  antisense strand of an RNAi agent
  modified_base 25: /mod_base = "2'-hydroxy corresponding nucleoside"
  modified_base 2,4,6,8,10,13,16,18,20: /mod_base = "2'-deoxy-2'-fluoro corresponding nucleoside"
  modified_base 3,5,7,9,11,12,14,15,17,19,21,22,23,24,26: /mod_base = "2'-O-methyl corresponding nucleoside"
  modified_base 2,3,23,24: /mod_base = "5'-phosphorothioate corresponding nucleotide"
tgagaagcugaggcucaaagcacuau

SEQ ID NO: 665 - DNA, 26 bp, artificial sequence
  antisense strand of an RNAi agent
  modified_base 25: /mod_base = "2'-hydroxy corresponding nucleoside"
  modified_base 2,4,6,8,10,12,13,15,17,19,21,23: /mod_base = "2'-deoxy-2'-fluoro corresponding nucleoside"
  modified_base 3,5,7,9,11,14,16,18,20,22,24,26: /mod_base = "2'-O-methyl corresponding nucleoside"
  modified_base 2,3,23,24: /mod_base = "5'-phosphorothioate corresponding nucleotide"
tgagaagcugaggcucaaagcacuau

SEQ ID NO: 666 - DNA, 26 bp, artificial sequence
  antisense strand of an RNAi agent
  modified_base 24: /mod_base = "2'-hydroxy corresponding nucleoside"
  modified_base 2,4,6,8,10,12,14,16,18,20: /mod_base = "2'-deoxy-2'-fluoro corresponding nucleoside"
  modified_base 3,5,7,9,11,13,15,17,19,21,22,23,25,26: /mod_base = "2'-O-methyl corresponding nucleoside"
  modified_base 2,3,23,24: /mod_base = "5'-phosphorothioate corresponding nucleotide"
tggucuuucacuuucuugggcauaua

SEQ ID NO: 667 - DNA, 26 bp, artificial sequence
  antisense strand of an RNAi agent
  modified_base 2,4,6,8,10,12,14,16,18,20,24: /mod_base = "2'-deoxy-2'-fluoro corresponding nucleoside"
  modified_base 3,5,7,9,11,13,15,17,19,21,22,23,25,26: /mod_base = "2'-O-methyl corresponding nucleoside"
  modified_base 2,3,25,26: /mod_base = "5'-phosphorothioate corresponding nucleotide"
tggucuuucacuuucuugggcauaua

SEQ ID NO: 668 - DNA, 28 bp, artificial sequence
  antisense strand of an RNAi agent
  modified_base 26: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 3,5,7,9,11,13,15,17,19,21,23,24,25,27,28: /mod_base = "2'-O-methyl corresponding nucleoside"
  modified_base 2,3,25,26: /mod_base = "5'-phosphorothioate corresponding nucleotide"
tggucuuucacuuucuugggcucauaua

SEQ ID NO: 669 - DNA, 26 bp, artificial sequence
  antisense strand of an RNAi agent
  modified_base 24: /mod_base = "2'-hydroxy corresponding nucleoside"
  modified_base 2,4,6,8,10,12,14,16,18,20: /mod_base = "2'-deoxy-2'-fluoro corresponding nucleoside"
  modified_base 3,5,7,9,11,13,15,17,19,21,22,23,25,26: /mod_base = "2'-O-methyl corresponding nucleoside"
  modified_base 2,3,23,24: /mod_base = "5'-phosphorothioate corresponding nucleotide"
tgagaagcugaggcucaaagcauaua

SEQ ID NO: 670 - DNA, 26 bp, artificial sequence
  antisense strand of an RNAi agent
  modified_base 2,4,6,8,10,12,14,16,18,20,24: /mod_base = "2'-deoxy-2'-fluoro corresponding nucleoside"
  modified_base 3,5,7,9,11,13,15,17,19,21,22,23,25,26: /mod_base = "2'-O-methyl corresponding nucleoside"
  modified_base 2,3,25,26: /mod_base = "5'-phosphorothioate corresponding nucleotide"
tgagaagcugaggcucaaagcauaua

SEQ ID NO: 671 - DNA, 28 bp, artificial sequence
  antisense strand of an RNAi agent
  modified_base 26: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 3,5,7,9,11,13,15,17,19,21,23,24,25,27,28: /mod_base = "2'-O-methyl corresponding nucleoside"
  modified_base 2,3,25,26: /mod_base = "5'-phosphorothioate corresponding nucleotide"
tgagaagcugaggcucaaagcacauaua

SEQ ID NO: 672 - DNA, 26 bp, artificial sequence
  antisense strand of an RNAi agent
  modified_base 25: /mod_base = "2'-hydroxy corresponding nucleoside"
  modified_base 1: /mod_base = "5' phosphorylated nucleotide"
  modified_base 2,4,6,8,10,14,16,18,20: /mod_base = "2'-deoxy-2'-fluoro corresponding nucleoside"
  modified_base 3,5,7,9,11,12,13,15,17,19,21,22,23,24,26: /mod_base = "2'-O-methyl corresponding nucleoside"
  modified_base 2,3,23,24: /mod_base = "5'-phosphorothioate corresponding nucleotide"
tggucuuucacuuucuugggcucuau

SEQ ID NO: 673 - DNA, 25 bp, artificial sequence
  antisense strand of an RNAi agent
  modified_base 25: /mod_base = "2'-hydroxy corresponding nucleoside"
  modified_base 1: /mod_base = "5' phosphorylated nucleotide"
  modified_base 2,4,6,8,10,14,16,18,20: /mod_base = "2'-deoxy-2'-fluoro corresponding nucleoside"
  modified_base 3,5,7,9,11,12,13,15,17,19,21,22,23,24: /mod_base = "2'-O-methyl corresponding nucleoside"
  modified_base 2,3,23,24: /mod_base = "5'-phosphorothioate corresponding nucleotide"
tggucuuucacuuucuugggcucua

SEQ ID NO: 674 - DNA, 25 bp, artificial sequence
  antisense strand of an RNAi agent
  modified_base 25: /mod_base = "2'-hydroxy corresponding nucleoside"
  modified_base 2,4,6,8,10,14,16,18,20: /mod_base = "2'-deoxy-2'-fluoro corresponding nucleoside"
  modified_base 3,5,7,9,11,12,13,15,17,19,21,22,23,24: /mod_base = "2'-O-methyl corresponding nucleoside"
  modified_base 2,3,23,24: /mod_base = "5'-phosphorothioate corresponding nucleotide"
tggucuuucacuuucuugggcucua

SEQ ID NO: 675 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 3,5,7,9,11,13,15,17,19,21,23,24,26: /mod_base = "2'-O-methyl corresponding nucleoside"
  modified_base 2,3,23,24: /mod_base = "5'-phosphorothioate corresponding nucleotide"
tcacuuucuugggcuccaaacaguau

SEQ ID NO: 676 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 3,5,7,9,11,13,15,17,19,21,23,24,26: /mod_base = "2'-O-methyl corresponding nucleoside"
  modified_base 2,3,23,24: /mod_base = "5'-phosphorothioate corresponding nucleotide"
tucacuuucuugggcuccaaacauau

SEQ ID NO: 677 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 3,5,7,9,11,13,15,17,19,21,23,24,26: /mod_base = "2'-O-methyl corresponding nucleoside"
  modified_base 2,3,23,24: /mod_base = "5'-phosphorothioate corresponding nucleotide"
tuucacuuucuugggcuccaaacuau

SEQ ID NO: 678 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 3,5,7,9,11,13,15,17,19,21,23,24,26: /mod_base = "2'-O-methyl corresponding nucleoside"
  modified_base 2,3,23,24: /mod_base = "5'-phosphorothioate corresponding nucleotide"
tuuucacuuucuugggcuccaaauau

SEQ ID NO: 679 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 3,5,7,9,11,13,15,17,19,21,23,24,26: /mod_base = "2'-O-methyl corresponding nucleoside"
  modified_base 2,3,23,24: /mod_base = "5'-phosphorothioate corresponding nucleotide"
tagcugaggcucaaagcacuucuuau

SEQ ID NO: 680 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 3,5,7,9,11,13,15,17,19,21,23,24,26: /mod_base = "2'-O-methyl corresponding nucleoside"
  modified_base 2,3,23,24: /mod_base = "5'-phosphorothioate corresponding nucleotide"
tgaagcugaggcucaaagcacuuuau

SEQ ID NO: 681 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 3,5,7,9,11,13,15,17,19,21,23,24,26: /mod_base = "2'-O-methyl corresponding nucleoside"
  modified_base 2,3,23,24: /mod_base = "5'-phosphorothioate corresponding nucleotide"
tuuguugcggucaccacagcccguau

SEQ ID NO: 682 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 3,5,7,9,11,13,15,17,19,21,23,24,26: /mod_base = "2'-O-methyl corresponding nucleoside"
  modified_base 2,3,23,24: /mod_base = "5'-phosphorothioate corresponding nucleotide"
tgcuuguugcggucaccacagccuau

SEQ ID NO: 683 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 3,5,7,9,11,13,15,17,19,21,23,24,26: /mod_base = "2'-O-methyl corresponding nucleoside"
  modified_base 2,3,23,24: /mod_base = "5'-phosphorothioate corresponding nucleotide"
tggcuuguugcggucaccacagcuau

SEQ ID NO: 684 - DNA, 26 bp, artificial sequence
  antisense strand of an RNAi agent
  modified_base 25: /mod_base = "2'-hydroxy corresponding nucleoside"
  modified_base 2,4,6,8,10,13,14,16,18,20: /mod_base = "2'-deoxy-2'-fluoro corresponding nucleoside"
  modified_base 3,5,7,9,11,12,15,17,19,21,22,23,24,26: /mod_base = "2'-O-methyl corresponding nucleoside"
  modified_base 2,24: /mod_base = "5'-phosphorothioate corresponding nucleotide"
tggucuuucacuuucuugggcucuau

SEQ ID NO: 685 - DNA, 26 bp, artificial sequence
  antisense strand of an RNAi agent
  modified_base 25: /mod_base = "2'-hydroxy corresponding nucleoside"
  modified_base 2,4,6,8,10,13,14,16,18,20: /mod_base = "2'-deoxy-2'-fluoro corresponding nucleoside"
  modified_base 3,5,7,9,11,12,15,17,19,21,22,23,24,26: /mod_base = "2'-O-methyl corresponding nucleoside"
  modified_base 2: /mod_base = "5'-phosphorothioate corresponding nucleotide"
tggucuuucacuuucuugggcucuau

SEQ ID NO: 686 - DNA, 26 bp, artificial sequence
  antisense strand of an RNAi agent
  modified_base 25: /mod_base = "2'-hydroxy corresponding nucleoside"
  modified_base 2,4,6,8,10,14,16,18,20: /mod_base = "2'-deoxy-2'-fluoro corresponding nucleoside"
  modified_base 3,5,7,9,11,12,13,15,17,19,21,22,23,24,26: /mod_base = "2'-O-methyl corresponding nucleoside"
  modified_base 2,24: /mod_base = "5'-phosphorothioate corresponding nucleotide"
tggucuuucacuuucuugggcucuau

SEQ ID NO: 687 - DNA, 26 bp, artificial sequence
  antisense strand of an RNAi agent
  modified_base 25: /mod_base = "2'-hydroxy corresponding nucleoside"
  modified_base 2,4,6,8,10,14,16,18,20: /mod_base = "2'-deoxy-2'-fluoro corresponding nucleoside"
  modified_base 3,5,7,9,11,12,13,15,17,19,21,22,23,24,26: /mod_base = "2'-O-methyl corresponding nucleoside"
  modified_base 2: /mod_base = "5'-phosphorothioate corresponding nucleotide"
tggucuuucacuuucuugggcucuau

SEQ ID NO: 688 - DNA, 26 bp, artificial sequence
  antisense strand of an RNAi agent
  modified_base 25: /mod_base = "2'-hydroxy corresponding nucleoside"
  modified_base 2,4,6,8,10,12,13,16,18,20: /mod_base = "2'-deoxy-2'-fluoro corresponding nucleoside"
  modified_base 3,5,7,9,11,14,15,17,19,21,22,23,24,26: /mod_base = "2'-O-methyl corresponding nucleoside"
  modified_base 2,24: /mod_base = "5'-phosphorothioate corresponding nucleotide"
tggucuuucacuuucuugggcucuau

SEQ ID NO: 689 - DNA, 26 bp, artificial sequence
  antisense strand of an RNAi agent
  modified_base 25: /mod_base = "2'-hydroxy corresponding nucleoside"
  modified_base 2,4,6,8,10,12,13,16,18,20: /mod_base = "2'-deoxy-2'-fluoro corresponding nucleoside"
  modified_base 3,5,7,9,11,14,15,17,19,21,22,23,24,26: /mod_base = "2'-O-methyl corresponding nucleoside"
  modified_base 2: /mod_base = "5'-phosphorothioate corresponding nucleotide"
tggucuuucacuuucuugggcucuau

SEQ ID NO: 690 - DNA, 26 bp, artificial sequence
  antisense strand of an RNAi agent
  modified_base 25: /mod_base = "2'-hydroxy corresponding nucleoside"
  modified_base 2,4,6,8,10,12,15,16,18,20: /mod_base = "2'-deoxy-2'-fluoro corresponding nucleoside"
  modified_base 3,5,7,9,11,13,14,17,19,21,22,23,24,26: /mod_base = "2'-O-methyl corresponding nucleoside"
  modified_base 2,24: /mod_base = "5'-phosphorothioate corresponding nucleotide"
tggucuuucacuuucuugggcucuau

SEQ ID NO: 691 - DNA, 26 bp, artificial sequence
  antisense strand of an RNAi agent
  modified_base 25: /mod_base = "2'-hydroxy corresponding nucleoside"
  modified_base 2,4,6,8,10,12,15,16,18,20: /mod_base = "2'-deoxy-2'-fluoro corresponding nucleoside"
  modified_base 3,5,7,9,11,13,14,17,19,21,22,23,24,26: /mod_base = "2'-O-methyl corresponding nucleoside"
  modified_base 2: /mod_base = "5'-phosphorothioate corresponding nucleotide"
tggucuuucacuuucuugggcucuau

SEQ ID NO: 692 - DNA, 26 bp, artificial sequence
  antisense strand of an RNAi agent
  modified_base 25: /mod_base = "2'-hydroxy corresponding nucleoside"
  modified_base 2,4,6,8,10,12,14,15,18,20: /mod_base = "2'-deoxy-2'-fluoro corresponding nucleoside"
  modified_base 3,5,7,9,11,13,16,17,19,21,22,23,24,26: /mod_base = "2'-O-methyl corresponding nucleoside"
  modified_base 2,24: /mod_base = "5'-phosphorothioate corresponding nucleotide"
tggucuuucacuuucuugggcucuau

SEQ ID NO: 693 - DNA, 26 bp, artificial sequence
  antisense strand of an RNAi agent
  modified_base 25: /mod_base = "2'-hydroxy corresponding nucleoside"
  modified_base 2,4,6,8,10,12,14,15,18,20: /mod_base = "2'-deoxy-2'-fluoro corresponding nucleoside"
  modified_base 3,5,7,9,11,13,16,17,19,21,22,23,24,26: /mod_base = "2'-O-methyl corresponding nucleoside"
  modified_base 2: /mod_base = "5'-phosphorothioate corresponding nucleotide"
tggucuuucacuuucuugggcucuau

SEQ ID NO: 694 - DNA, 26 bp, artificial sequence
  antisense strand of an RNAi agent
  modified_base 25: /mod_base = "2'-hydroxy corresponding nucleoside"
  modified_base 13: /mod_base = "2'-3' seco corresponding nucleotide"
  modified_base 2,4,6,8,10,12,14,16,18,20: /mod_base = "2'-deoxy-2'-fluoro corresponding nucleoside"
  modified_base 3,5,7,9,11,15,17,19,21,22,23,24,26: /mod_base = "2'-O-methyl corresponding nucleoside"
  modified_base 2,24: /mod_base = "5'-phosphorothioate corresponding nucleotide"
tggucuuucacuuucuugggcucuau

SEQ ID NO: 695 - DNA, 26 bp, artificial sequence
  antisense strand of an RNAi agent
  modified_base 25: /mod_base = "2'-hydroxy corresponding nucleoside"
  modified_base 10: /mod_base = "2'-3' seco corresponding nucleotide"
  modified_base 2,4,6,8,12,14,16,18,20: /mod_base = "2'-deoxy-2'-fluoro corresponding nucleoside"
  modified_base 3,5,7,9,11,13,15,17,19,21,22,23,24,26: /mod_base = "2'-O-methyl corresponding nucleoside"
  modified_base 2,24: /mod_base = "5'-phosphorothioate corresponding nucleotide"
tggucuuucacuuucuugggcucuau

SEQ ID NO: 696 - DNA, 23 bp, artificial sequence
  antisense strand of an RNAi agent
  modified_base 4,6,8,10,14,16,20: /mod_base = "2'-deoxy-2'-fluoro corresponding nucleoside"
  modified_base 2,3,5,7,9,11,12,13,15,17,18,19,21,22,23: /mod_base = "2'-O-methyl corresponding nucleoside"
  modified_base 2,3,22,23: /mod_base = "5'-phosphorothioate corresponding nucleotide"
tgucuuucacuuucuugggcucc

SEQ ID NO: 697 - DNA, 23 bp, artificial sequence
  antisense strand of an RNAi agent
  modified_base 2,6,8,10,14,16,18: /mod_base = "2'-deoxy-2'-fluoro corresponding nucleoside"
  modified_base 3,4,5,7,9,11,12,13,15,17,19,20,21,22,23: /mod_base = "2'-O-methyl corresponding nucleoside"
  modified_base 2,3,22,23: /mod_base = "5'-phosphorothioate corresponding nucleotide"
tuggucuuucacuuucuugggcu

SEQ ID NO: 698 - DNA, 23 bp, artificial sequence
  antisense strand of an RNAi agent
  modified_base 4,6,8,10,14,16,18: /mod_base = "2'-deoxy-2'-fluoro corresponding nucleoside"
  modified_base 2,3,5,7,9,11,12,13,15,17,19,20,21,22,23: /mod_base = "2'-O-methyl corresponding nucleoside"
  modified_base 2,3,22,23: /mod_base = "5'-phosphorothioate corresponding nucleotide"
tgagaagcugaggcucaaagcac

SEQ ID NO: 699 - DNA, 26 bp, artificial sequence
  antisense strand of an RNAi agent
  modified_base 23,24,25,26: /mod_base = "2'-hydroxy corresponding nucleoside"
  modified_base 2,4,6,8,10,13,14,16,18,20: /mod_base = "2'-deoxy-2'-fluoro corresponding nucleoside"
  modified_base 3,5,7,9,11,12,15,17,19,21,22: /mod_base = "2'-O-methyl corresponding nucleoside"
  modified_base 2,23: /mod_base = "5'-phosphorothioate corresponding nucleotide"
tggucuuucacuuucuugggcucuau

SEQ ID NO: 700 - DNA, 26 bp, artificial sequence
  antisense strand of an RNAi agent
  modified_base 23: /mod_base = "2'-hydroxy corresponding nucleoside"
  modified_base 2,4,6,8,10,13,14,16,18,20,25: /mod_base = "2'-deoxy-2'-fluoro corresponding nucleoside"
  modified_base 3,5,7,9,11,12,15,17,19,21,22,24,26: /mod_base = "2'-O-methyl corresponding nucleoside"
  modified_base 2,23: /mod_base = "5'-phosphorothioate corresponding nucleotide"
tggucuuucacuuucuugggcucuau

SEQ ID NO: 701 - DNA, 26 bp, artificial sequence
  antisense strand of an RNAi agent
  modified_base 23: /mod_base = "2'-hydroxy corresponding nucleoside"
  modified_base 2,4,6,8,10,13,14,16,18,20: /mod_base = "2'-deoxy-2'-fluoro corresponding nucleoside"
  modified_base 3,5,7,9,11,12,15,17,19,21,22,24,25,26: /mod_base = "2'-O-methyl corresponding nucleoside"
  modified_base 2,23: /mod_base = "5'-phosphorothioate corresponding nucleotide"
tggucuuucacuuucuugggcucuau

SEQ ID NO: 702 - DNA, 26 bp, artificial sequence
  antisense strand of an RNAi agent
  modified_base 25: /mod_base = "2'-hydroxy corresponding nucleoside"
  modified_base 6: /mod_base = "2'-3' seco corresponding nucleotide"
  modified_base 2,4,8,10,13,14,16,18,20: /mod_base = "2'-deoxy-2'-fluoro corresponding nucleoside"
  modified_base 3,5,7,9,11,12,15,17,19,21,22,23,24,26: /mod_base = "2'-O-methyl corresponding nucleoside"
  modified_base 2,24: /mod_base = "5'-phosphorothioate corresponding nucleotide"
tggucuuucacuuucuugggcucuau

SEQ ID NO: 703 - DNA, 21 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
  modified_base 21: /mod_base = "3' end (PaZ) modification"
tggucuuucacuuucuuggta

SEQ ID NO: 704 - DNA, 19 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 19: /mod_base = "3' end (PaZ) modification"
tggucuuucacuuucuugg

SEQ ID NO: 705 - DNA, 19 bp, artificial sequence
  antisense strand of an RNAi agent
  modified_base 6: /mod_base = "2'-3' seco corresponding nucleotide"
  modified_base 2,4,8,10,12,14,16,18: /mod_base = "2'-deoxy-2'-fluoro corresponding nucleoside"
  modified_base 3,5,7,9,11,13,15,17: /mod_base = "2'-O-methyl corresponding nucleoside"
  modified_base 19: /mod_base = "abasic corresponding nucleoside"
  modified_base 19: /mod_base = "3' end (PaZ) modification"
tggucuuucacuuucuugn

SEQ ID NO: 706 - DNA, 19 bp, artificial sequence
  antisense strand of an RNAi agent
  modified_base 6: /mod_base = "2'-3' seco corresponding nucleotide"
  modified_base 2,4,8,10,12,14,16: /mod_base = "2'-deoxy-2'-fluoro corresponding nucleoside"
  modified_base 3,5,7,9,11,13,15,17: /mod_base = "2'-O-methyl corresponding nucleoside"
  modified_base 18,19: /mod_base = "abasic corresponding nucleoside"
  modified_base 19: /mod_base = "3' end (PaZ) modification"
tggucuuucacuuucuunn

SEQ ID NO: 707 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
  modified_base 21: /mod_base = "3' end (PaZ) modification"
tggucuuucacuuucuuggta

SEQ ID NO: 708 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 19: /mod_base = "3' end (PaZ) modification"
tggucuuucacuuucuugg

SEQ ID NO: 709 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17: /mod_base = "2'-O-methyl corresponding nucleoside"
  modified_base 19: /mod_base = "abasic corresponding nucleoside"
  modified_base 19: /mod_base = "3' end (PaZ) modification"
tggucuuucacuuucuugn

SEQ ID NO: 710 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 3,5,7,9,11,13,15,17: /mod_base = "2'-O-methyl corresponding nucleoside"
  modified_base 18,19: /mod_base = "abasic corresponding nucleoside"
  modified_base 19: /mod_base = "3' end (PaZ) modification"
tggucuuucacuuucuunn

SEQ ID NO: 711 - DNA, 23 bp, artificial sequence
  antisense strand of an RNAi agent
  modified_base 4,6,8,10,14,16: /mod_base = "2'-deoxy-2'-fluoro corresponding nucleoside"
  modified_base 2,3,5,7,9,11,12,13,15,17,18,19,20,21,22,23: /mod_base = "2'-O-methyl corresponding nucleoside"
  modified_base 2,3,22,23: /mod_base = "5'-phosphorothioate corresponding nucleotide"
tggucuuucacuuucuugggcuc

SEQ ID NO: 712 - DNA, 26 bp, artificial sequence
  antisense strand of an RNAi agent
  modified_base 25: /mod_base = "2'-hydroxy corresponding nucleoside"
  modified_base 2,4,6,8,10,14,16,18,20: /mod_base = "2'-deoxy-2'-fluoro corresponding nucleoside"
  modified_base 1,3,5,7,9,11,12,13,15,17,19,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 713 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,18,20,22: /mod_base = "2'-deoxy-2'-fluoro corresponding nucleoside"
  modified_base 1,3,5,7,9,11,13,15,17,19,21,23,24,26: /mod_base = "2'-O-methyl corresponding nucleoside"
  modified_base 2,3,23,24: /mod_base = "5'-phosphorothioate corresponding nucleotide"
ugaagcugaggcucaaagcacuuuau

SEQ ID NO: 714 - DNA, 26 bp, artificial sequence
  antisense strand of an RNAi agent
  modified_base 25: /mod_base = "2'-hydroxy corresponding nucleoside"
  modified_base 4,6,8,10,12,14,16,18,20,22: /mod_base = "2'-deoxy-2'-fluoro corresponding nucleoside"
  modified_base 2,3,5,7,9,11,13,15,17,19,21,23,24,26: /mod_base = "2'-O-methyl corresponding nucleoside"
  modified_base 2,3,23,24: /mod_base = "5'-phosphorothioate corresponding nucleotide"
tgaagcugaggcucaaagcacuuuau

SEQ ID NO: 715 - DNA, 26 bp, artificial sequence
  antisense strand of an RNAi agent
  modified_base 25: /mod_base = "2'-hydroxy corresponding nucleoside"
  modified_base 2,4,6,10,12,14,16,18,20,22: /mod_base = "2'-deoxy-2'-fluoro corresponding nucleoside"
  modified_base 3,5,7,8,9,11,13,15,17,19,21,23,24,26: /mod_base = "2'-O-methyl corresponding nucleoside"
  modified_base 2,3,23,24: /mod_base = "5'-phosphorothioate corresponding nucleotide"
tgaagcugaggcucaaagcacuuuau

SEQ ID NO: 716 - DNA, 26 bp, artificial sequence
  antisense strand of an RNAi agent
  modified_base 25: /mod_base = "2'-hydroxy corresponding nucleoside"
  modified_base 2,4,6,8,12,14,16,18,20,22: /mod_base = "2'-deoxy-2'-fluoro corresponding nucleoside"
  modified_base 3,5,7,9,10,11,13,15,17,19,21,23,24,26: /mod_base = "2'-O-methyl corresponding nucleoside"
  modified_base 2,3,23,24: /mod_base = "5'-phosphorothioate corresponding nucleotide"
tgaagcugaggcucaaagcacuuuau

SEQ ID NO: 717 - DNA, 26 bp, artificial sequence
  antisense strand of an RNAi agent
  modified_base 25: /mod_base = "2'-hydroxy corresponding nucleoside"
  modified_base 2,4,6,8,10,12,14,16,20,22: /mod_base = "2'-deoxy-2'-fluoro corresponding nucleoside"
  modified_base 3,5,7,9,11,13,15,17,18,19,21,23,24,26: /mod_base = "2'-O-methyl corresponding nucleoside"
  modified_base 2,3,23,24: /mod_base = "5'-phosphorothioate corresponding nucleotide"
tgaagcugaggcucaaagcacuuuau

SEQ ID NO: 718 - DNA, 26 bp, artificial sequence
  antisense strand of an RNAi agent
  modified_base 25: /mod_base = "2'-hydroxy corresponding nucleoside"
  modified_base 4,6,12,14,16,20,22: /mod_base = "2'-deoxy-2'-fluoro corresponding nucleoside"
  modified_base 2,3,5,7,8,9,10,11,13,15,17,18,19,21,23,24,26: /mod_base = "2'-O-methyl corresponding nucleoside"
  modified_base 2,3,23,24: /mod_base = "5'-phosphorothioate corresponding nucleotide"
tgaagcugaggcucaaagcacuuuau

SEQ ID NO: 719 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ucacuuucuugggcuccan

SEQ ID NO: 720 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uucacuuucuugggcuccn

SEQ ID NO: 721 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uuucacuuucuugggcucn

SEQ ID NO: 722 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uuuucacuuucuugggcun

SEQ ID NO: 723 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ucuuucacuuucuugggcn

SEQ ID NO: 724 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uucuuucacuuucuugggn

SEQ ID NO: 725 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ugucuuucacuuucuuggn

SEQ ID NO: 726 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uggucuuucacuuucuugn

SEQ ID NO: 727 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uuggucuuucacuuucuun

SEQ ID NO: 728 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uagcugaggcucaaagcan

SEQ ID NO: 729 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ugaagcugaggcucaaagn

SEQ ID NO: 730 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ugagaagcugaggcucaan

SEQ ID NO: 731 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uuuguugcggucaccacan

SEQ ID NO: 732 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ucuuguugcggucaccacn

SEQ ID NO: 733 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ugcuuguugcggucaccan

SEQ ID NO: 734 - DNA, 19 bp, artificial sequence
  antisense strand of an RNAi agent
  modified_base 2,4,6,8,10,12,14,16,18: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uggcuuguugcggucaccn

SEQ ID NO: 735 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ucacuuucuugggcuccnn

SEQ ID NO: 736 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uucacuuucuugggcucnn

SEQ ID NO: 737 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uuucacuuucuugggcunn

SEQ ID NO: 738 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uuuucacuuucuugggcnn

SEQ ID NO: 739 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ucuuucacuuucuugggnn

SEQ ID NO: 740 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uucuuucacuuucuuggnn

SEQ ID NO: 741 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ugucuuucacuuucuugnn

SEQ ID NO: 742 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uggucuuucacuuucuunn

SEQ ID NO: 743 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uuggucuuucacuuucunn

SEQ ID NO: 744 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uagcugaggcucaaagcnn

SEQ ID NO: 745 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ugaagcugaggcucaaann

SEQ ID NO: 746 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ugagaagcugaggcucann

SEQ ID NO: 747 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uuuguugcggucaccacnn

SEQ ID NO: 748 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ucuuguugcggucaccann

SEQ ID NO: 749 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ugcuuguugcggucaccnn

SEQ ID NO: 750 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uggcuuguugcggucacnn

SEQ ID NO: 751 - DNA, 26 bp, artificial sequence
  antisense strand of an RNAi agent
  modified_base 25: /mod_base = "2'-hydroxy corresponding nucleoside"
  modified_base 1: /mod_base = "5' phosphorylated nucleotide"
  modified_base 2,4,6,8,10,13,14,16,18,20: /mod_base = "2'-deoxy-2'-fluoro corresponding nucleoside"
  modified_base 3,5,7,9,11,12,15,17,19,21,22,23,24,26: /mod_base = "2'-O-methyl corresponding nucleoside"
  modified_base 2,24: /mod_base = "5'-phosphorothioate corresponding nucleotide"
tggucuuucacuuucuugggcucuau

SEQ ID NO: 752 - DNA, 26 bp, artificial sequence
  antisense strand of an RNAi agent
  modified_base 25: /mod_base = "2'-hydroxy corresponding nucleoside"
  modified_base 1: /mod_base = "5' phosphorylated nucleotide"
  modified_base 2,4,6,8,10,12,14,15,18,20: /mod_base = "2'-deoxy-2'-fluoro corresponding nucleoside"
  modified_base 3,5,7,9,11,13,16,17,19,21,22,23,24,26: /mod_base = "2'-O-methyl corresponding nucleoside"
  modified_base 2: /mod_base = "5'-phosphorothioate corresponding nucleotide"
tggucuuucacuuucuugggcucuau

SEQ ID NO: 753 - DNA, 26 bp, artificial sequence
  antisense strand of an RNAi agent
  modified_base 25: /mod_base = "2'-hydroxy corresponding nucleoside"
  modified_base 2,4,6,8,10,12,14,15,18,20: /mod_base = "2'-deoxy-2'-fluoro corresponding nucleoside"
  modified_base 1,3,5,7,9,11,13,16,17,19,21,22,23,24,26: /mod_base = "2'-O-methyl corresponding nucleoside"
  modified_base 2: /mod_base = "5'-phosphorothioate corresponding nucleotide"
uggucuuucacuuucuugggcucuau

SEQ ID NO: 754 - DNA, 25 bp, artificial sequence
  antisense strand of an RNAi agent
  modified_base 25: /mod_base = "2'-hydroxy corresponding nucleoside"
  modified_base 2,4,6,8,10,12,14,15,18,20: /mod_base = "2'-deoxy-2'-fluoro corresponding nucleoside"
  modified_base 3,5,7,9,11,13,16,17,19,21,22,23,24: /mod_base = "2'-O-methyl corresponding nucleoside"
  modified_base 2: /mod_base = "5'-phosphorothioate corresponding nucleotide"
tggucuuucacuuucuugggcucua

SEQ ID NO: 755 - DNA, 24 bp, artificial sequence
  antisense strand of an RNAi agent
  modified_base 24: /mod_base = "2'-hydroxy corresponding nucleoside"
  modified_base 1,3,5,7,9,11,13,14,17,19: /mod_base = "2'-deoxy-2'-fluoro corresponding nucleoside"
  modified_base 2,4,6,8,10,12,15,16,18,20,21,22,23: /mod_base = "2'-O-methyl corresponding nucleoside"
ggucuuucacuuucuugggcucua

SEQ ID NO: 756 - DNA, 23 bp, artificial sequence
  antisense strand of an RNAi agent
  modified_base 23: /mod_base = "2'-hydroxy corresponding nucleoside"
  modified_base 2,4,6,8,10,12,13,16,18: /mod_base = "2'-deoxy-2'-fluoro corresponding nucleoside"
  modified_base 1,3,5,7,9,11,14,15,17,19,20,21,22: /mod_base = "2'-O-methyl corresponding nucleoside"
gucuuucacuuucuugggcucua

SEQ ID NO: 757 - DNA, 22 bp, artificial sequence
  antisense strand of an RNAi agent
  modified_base 22: /mod_base = "2'-hydroxy corresponding nucleoside"
  modified_base 1,3,5,7,9,11,12,15,17: /mod_base = "2'-deoxy-2'-fluoro corresponding nucleoside"
  modified_base 2,4,6,8,10,13,14,16,18,19,20,21: /mod_base = "2'-O-methyl corresponding nucleoside"
ucuuucacuuucuugggcucua

SEQ ID NO: 758 - DNA, 25 bp, artificial sequence
  antisense strand of an RNAi agent
  modified_base 25: /mod_base = "2'-hydroxy corresponding nucleoside"
  modified_base 1: /mod_base = "5' phosphorylated nucleotide"
  modified_base 2,4,6,8,10,12,14,15,18,20: /mod_base = "2'-deoxy-2'-fluoro corresponding nucleoside"
  modified_base 3,5,7,9,11,13,16,17,19,21,22,23,24: /mod_base = "2'-O-methyl corresponding nucleoside"
  modified_base 2: /mod_base = "5'-phosphorothioate corresponding nucleotide"
tggucuuucacuuucuugggcucua

SEQ ID NO: 759 - DNA, 24 bp, artificial sequence
  antisense strand of an RNAi agent
  modified_base 24: /mod_base = "2'-hydroxy corresponding nucleoside"
  modified_base 1: /mod_base = "5' phosphorylated nucleotide"
  modified_base 1,3,5,7,9,11,13,14,17,19: /mod_base = "2'-deoxy-2'-fluoro corresponding nucleoside"
  modified_base 2,4,6,8,10,12,15,16,18,20,21,22,23: /mod_base = "2'-O-methyl corresponding nucleoside"
  modified_base 24: /mod_base = "3' end phosphate modification"
ggucuuucacuuucuugggcucua

SEQ ID NO: 760 - DNA, 23 bp, artificial sequence
  antisense strand of an RNAi agent
  modified_base 23: /mod_base = "2'-hydroxy corresponding nucleoside"
  modified_base 1: /mod_base = "5' phosphorylated nucleotide"
  modified_base 2,4,6,8,10,12,13,16,18: /mod_base = "2'-deoxy-2'-fluoro corresponding nucleoside"
  modified_base 1,3,5,7,9,11,14,15,17,19,20,21,22: /mod_base = "2'-O-methyl corresponding nucleoside"
  modified_base 1: /mod_base = "5' end phosphate modification"
gucuuucacuuucuugggcucua

SEQ ID NO: 761 - DNA, 22 bp, artificial sequence
  antisense strand of an RNAi agent
  modified_base 22: /mod_base = "2'-hydroxy corresponding nucleoside"
  modified_base 1: /mod_base = "5' phosphorylated nucleotide"
  modified_base 1,3,5,7,9,11,12,15,17: /mod_base = "2'-deoxy-2'-fluoro corresponding nucleoside"
  modified_base 2,4,6,8,10,13,14,16,18,19,20,21: /mod_base = "2'-O-methyl corresponding nucleoside"
  modified_base 1: /mod_base = "5' end phosphate modification"
ucuuucacuuucuugggcucua

SEQ ID NO: 762 - DNA, 25 bp, artificial sequence
  antisense strand of an RNAi agent
  modified_base 24: /mod_base = "2'-hydroxy corresponding nucleoside"
  modified_base 1,3,5,7,9,11,13,14,17,19: /mod_base = "2'-deoxy-2'-fluoro corresponding nucleoside"
  modified_base 2,4,6,8,10,12,15,16,18,20,21,22,23,25: /mod_base = "2'-O-methyl corresponding nucleoside"
ggucuuucacuuucuugggcucuau

SEQ ID NO: 763 - DNA, 25 bp, artificial sequence
  antisense strand of an RNAi agent
  modified_base 24: /mod_base = "2'-hydroxy corresponding nucleoside"
  modified_base 1: /mod_base = "5' phosphorylated nucleotide"
  modified_base 1,3,5,7,9,11,13,14,17,19: /mod_base = "2'-deoxy-2'-fluoro corresponding nucleoside"
  modified_base 2,4,6,8,10,12,15,16,18,20,21,22,23,25: /mod_base = "2'-O-methyl corresponding nucleoside"
ggucuuucacuuucuugggcucuau

SEQ ID NO: 764 - DNA, 24 bp, artificial sequence
  antisense strand of an RNAi agent
  modified_base 2,4,6,8,10,12,14,15,18,20: /mod_base = "2'-deoxy-2'-fluoro corresponding nucleoside"
  modified_base 3,5,7,9,11,13,16,17,19,21,22,23,24: /mod_base = "2'-O-methyl corresponding nucleoside"
  modified_base 2: /mod_base = "5'-phosphorothioate corresponding nucleotide"
tggucuuucacuuucuugggcucu

SEQ ID NO: 765 - DNA, 24 bp, artificial sequence
  antisense strand of an RNAi agent
  modified_base 1: /mod_base = "5' phosphorylated nucleotide"
  modified_base 2,4,6,8,10,12,14,15,18,20: /mod_base = "2'-deoxy-2'-fluoro corresponding nucleoside"
  modified_base 3,5,7,9,11,13,16,17,19,21,22,23,24: /mod_base = "2'-O-methyl corresponding nucleoside"
  modified_base 2: /mod_base = "5'-phosphorothioate corresponding nucleotide"
tggucuuucacuuucuugggcucu

SEQ ID NO: 766 - DNA, 26 bp, artificial sequence
  antisense strand of an RNAi agent
  modified_base 25: /mod_base = "2'-hydroxy corresponding nucleoside"
  modified_base 4,6,8,10,14,16: /mod_base = "2'-deoxy-2'-fluoro corresponding nucleoside"
  modified_base 1,2,3,5,7,9,11,12,13,15,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 767 - DNA, 26 bp, artificial sequence
  antisense strand of an RNAi agent
  modified_base 25: /mod_base = "2'-hydroxy corresponding nucleoside"
  modified_base 2,4,6,8,10,14,16: /mod_base = "2'-deoxy-2'-fluoro corresponding nucleoside"
  modified_base 1,3,5,7,9,11,12,13,15,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 768 - DNA, 26 bp, artificial sequence
  antisense strand of an RNAi agent
  modified_base 25: /mod_base = "2'-hydroxy corresponding nucleoside"
  modified_base 2,4,6,10,14: /mod_base = "2'-deoxy-2'-fluoro corresponding nucleoside"
  modified_base 1,3,5,7,8,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 769 - DNA, 26 bp, artificial sequence
  antisense strand of an RNAi agent
  modified_base 25: /mod_base = "2'-hydroxy corresponding nucleoside"
  modified_base 2,4,8,10,14: /mod_base = "2'-deoxy-2'-fluoro corresponding nucleoside"
  modified_base 1,3,5,6,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 770 - DNA, 26 bp, artificial sequence
  antisense strand of an RNAi agent
  modified_base 25: /mod_base = "2'-hydroxy corresponding nucleoside"
  modified_base 2,6,8,10,14: /mod_base = "2'-deoxy-2'-fluoro corresponding nucleoside"
  modified_base 1,3,4,5,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 771 - DNA, 26 bp, artificial sequence
  antisense strand of an RNAi agent
  modified_base 25: /mod_base = "2'-hydroxy corresponding nucleoside"
  modified_base 2,4,10,14,16: /mod_base = "2'-deoxy-2'-fluoro corresponding nucleoside"
  modified_base 1,3,5,6,7,8,9,11,12,13,15,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 772 - DNA, 26 bp, artificial sequence
  antisense strand of an RNAi agent
  modified_base 25: /mod_base = "2'-hydroxy corresponding nucleoside"
  modified_base 2,6,10,14,16: /mod_base = "2'-deoxy-2'-fluoro corresponding nucleoside"
  modified_base 1,3,4,5,7,8,9,11,12,13,15,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 773 - DNA, 26 bp, artificial sequence
  antisense strand of an RNAi agent
  modified_base 25: /mod_base = "2'-hydroxy corresponding nucleoside"
  modified_base 2,8,10,14,16: /mod_base = "2'-deoxy-2'-fluoro corresponding nucleoside"
  modified_base 1,3,4,5,6,7,9,11,12,13,15,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 774 - DNA, 26 bp, artificial sequence
  antisense strand of an RNAi agent
  modified_base 25: /mod_base = "2'-hydroxy corresponding nucleoside"
  modified_base 2,4,5,6,10,14: /mod_base = "2'-deoxy-2'-fluoro corresponding nucleoside"
  modified_base 1,3,7,8,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 775 - DNA, 26 bp, artificial sequence
  antisense strand of an RNAi agent
  modified_base 25: /mod_base = "2'-hydroxy corresponding nucleoside"
  modified_base 2,4,5,8,10,14: /mod_base = "2'-deoxy-2'-fluoro corresponding nucleoside"
  modified_base 1,3,6,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 776 - DNA, 26 bp, artificial sequence
  antisense strand of an RNAi agent
  modified_base 25: /mod_base = "2'-hydroxy corresponding nucleoside"
  modified_base 2,5,6,8,10,14: /mod_base = "2'-deoxy-2'-fluoro corresponding nucleoside"
  modified_base 1,3,4,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 777 - DNA, 25 bp, artificial sequence
  antisense strand of an RNAi agent
  modified_base 24: /mod_base = "2'-hydroxy corresponding nucleoside"
  modified_base 3,5,7,9,13,15: /mod_base = "2'-deoxy-2'-fluoro corresponding nucleoside"
  modified_base 1,2,4,6,8,10,11,12,14,16,17,18,19,20,21,22,23,25: /mod_base = "2'-O-methyl corresponding nucleoside"
  modified_base 2,21,22: /mod_base = "5'-phosphorothioate corresponding nucleotide"
ggucuuucacuuucuugggcucuau

SEQ ID NO: 778 - DNA, 24 bp, artificial sequence
  antisense strand of an RNAi agent
  modified_base 23: /mod_base = "2'-hydroxy corresponding nucleoside"
  modified_base 2,4,6,8,12,14: /mod_base = "2'-deoxy-2'-fluoro corresponding nucleoside"
  modified_base 1,3,5,7,9,10,11,13,15,16,17,18,19,20,21,22,24: /mod_base = "2'-O-methyl corresponding nucleoside"
  modified_base 20,21: /mod_base = "5'-phosphorothioate corresponding nucleotide"
gucuuucacuuucuugggcucuau

SEQ ID NO: 779 - DNA, 26 bp, artificial sequence
  antisense strand of an RNAi agent
  modified_base 25: /mod_base = "2'-hydroxy corresponding nucleoside"
  modified_base 2,4,6,8,10,12,14,15,18,20: /mod_base = "2'-deoxy-2'-fluoro corresponding nucleoside"
  modified_base 3,5,7,9,11,13,16,17,19,21,22,23,24,26: /mod_base = "2'-O-methyl corresponding nucleoside"
tggucuuucacuuucuugggcucuau

SEQ ID NO: 780 - DNA, 24 bp, artificial sequence
  antisense strand of an RNAi agent
  modified_base 23: /mod_base = "2'-hydroxy corresponding nucleoside"
  modified_base 2,4,6,8,10,12,13,16,18: /mod_base = "2'-deoxy-2'-fluoro corresponding nucleoside"
  modified_base 1,3,5,7,9,11,14,15,17,19,20,21,22,24: /mod_base = "2'-O-methyl corresponding nucleoside"
gucuuucacuuucuugggcucuau

SEQ ID NO: 781 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
ucacuuucuugggcuccnn

SEQ ID NO: 782 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
ucuuucacuuucuugggnn

SEQ ID NO: 783 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
uggucuuucacuuucuunn

SEQ ID NO: 784 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
uuggucuuucacuuucunn

SEQ ID NO: 785 - DNA, 26 bp, artificial sequence
  antisense strand of an RNAi agent
  modified_base 25: /mod_base = "2'-hydroxy corresponding nucleoside"
  modified_base 2,4,6,8,10,14,16,18,20: /mod_base = "2'-deoxy-2'-fluoro corresponding nucleoside"
  modified_base 1,3,5,7,9,11,12,13,15,17,19,21,24,26: /mod_base = "2'-O-methyl corresponding nucleoside"
  modified_base 22,23: /mod_base = "2'-MOE nucleotide"
  modified_base 2,3,22,23: /mod_base = "5'-phosphorothioate corresponding nucleotide"
uggucuuucacuuucuugggctcuau

SEQ ID NO: 786 - DNA, 26 bp, artificial sequence
  antisense strand of an RNAi agent
  modified_base 25: /mod_base = "2'-hydroxy corresponding nucleoside"
  modified_base 2,4,6,8,10,14,16,18,20: /mod_base = "2'-deoxy-2'-fluoro corresponding nucleoside"
  modified_base 1,3,5,7,9,11,12,13,15,17,19,21,24,26: /mod_base = "2'-O-methyl corresponding nucleoside"
  modified_base 22,23: /mod_base = "2'-MOE nucleotide"
  modified_base 2,3: /mod_base = "5'-phosphorothioate corresponding nucleotide"
uggucuuucacuuucuugggctcuau

SEQ ID NO: 787 - DNA, 26 bp, artificial sequence
  antisense strand of an RNAi agent
  modified_base 25: /mod_base = "2'-hydroxy corresponding nucleoside"
  modified_base 2,4,6,8,10,14,16,18,20: /mod_base = "2'-deoxy-2'-fluoro corresponding nucleoside"
  modified_base 1,3,5,7,9,11,12,13,15,17,19,21,22,23,24,26: /mod_base = "2'-O-methyl corresponding nucleoside"
  modified_base 2,3: /mod_base = "5'-phosphorothioate corresponding nucleotide"
uggucuuucacuuucuugggcucuau

SEQ ID NO: 788 - DNA, 26 bp, artificial sequence
  antisense strand of an RNAi agent
  modified_base 25: /mod_base = "2'-hydroxy corresponding nucleoside"
  modified_base 2,14: /mod_base = "2'-deoxy-2'-fluoro corresponding nucleoside"
  modified_base 1,3,4,5,6,7,8,9,10,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 789 - DNA, 26 bp, artificial sequence
  antisense strand of an RNAi agent
  modified_base 25: /mod_base = "2'-hydroxy corresponding nucleoside"
  modified_base 2,10,14: /mod_base = "2'-deoxy-2'-fluoro corresponding nucleoside"
  modified_base 1,3,4,5,6,7,8,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 790 - DNA, 26 bp, artificial sequence
  antisense strand of an RNAi agent
  modified_base 25: /mod_base = "2'-hydroxy corresponding nucleoside"
  modified_base 2,8,14: /mod_base = "2'-deoxy-2'-fluoro corresponding nucleoside"
  modified_base 1,3,4,5,6,7,9,10,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 791 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 792 - DNA, 23 bp, artificial sequence
  antisense strand of an RNAi agent
  modified_base 2,4,6,8,10,12,14,15,18,20: /mod_base = "2'-deoxy-2'-fluoro corresponding nucleoside"
  modified_base 3,5,7,9,11,13,16,17,19,21,22,23: /mod_base = "2'-O-methyl corresponding nucleoside"
  modified_base 2: /mod_base = "5'-phosphorothioate corresponding nucleotide"
tggucuuucacuuucuugggcuc

SEQ ID NO: 793 - DNA, 23 bp, artificial sequence
  antisense strand of an RNAi agent
  modified_base 1: 5' phosphorylated nucleotide"
  modified_base 2,4,6,8,10,12,14,15,18,20: /mod_base = "2'-deoxy-2'-fluoro corresponding nucleoside"
  modified_base 3,5,7,9,11,13,16,17,19,21,22,23: /mod_base = "2'-O-methyl corresponding nucleoside"
  modified_base 2: /mod_base = "5'-phosphorothioate corresponding nucleotide"
tggucuuucacuuucuugggcuc

SEQ ID NO: 794 - DNA, 23 bp, artificial sequence
  antisense strand of an RNAi agent
  modified_base 1,3,5,7,9,11,13,14,17,19: /mod_base = "2'-deoxy-2'-fluoro corresponding nucleoside"
  modified_base 2,4,6,8,10,12,15,16,18,20,21,22,23: /mod_base = "2'-O-methyl corresponding nucleoside"
ggucuuucacuuucuugggcucu

SEQ ID NO: 795 - DNA, 23 bp, artificial sequence
  antisense strand of an RNAi agent
  modified_base 1: 5' phosphorylated nucleotide"
  modified_base 1,3,5,7,9,11,13,14,17,19: /mod_base = "2'-deoxy-2'-fluoro corresponding nucleoside"
  modified_base 2,4,6,8,10,12,15,16,18,20,21,22,23: /mod_base = "2'-O-methyl corresponding nucleoside"
ggucuuucacuuucuugggcucu

SEQ ID NO: 796 - DNA, 22 bp, artificial sequence
  antisense strand of an RNAi agent
  modified_base 2,4,6,8,10,12,14,15,18,20: /mod_base = "2'-deoxy-2'-fluoro corresponding nucleoside"
  modified_base 3,5,7,9,11,13,16,17,19,21,22: /mod_base = "2'-O-methyl corresponding nucleoside"
  modified_base 2: /mod_base = "5'-phosphorothioate corresponding nucleotide"
tggucuuucacuuucuugggcu

SEQ ID NO: 797 - DNA, 22 bp, artificial sequence
  antisense strand of an RNAi agent
  modified_base 1: 5' phosphorylated nucleotide"
  modified_base 2,4,6,8,10,12,14,15,18,20: /mod_base = "2'-deoxy-2'-fluoro corresponding nucleoside"
  modified_base 3,5,7,9,11,13,16,17,19,21,22: /mod_base = "2'-O-methyl corresponding nucleoside"
  modified_base 2: /mod_base = "5'-phosphorothioate corresponding nucleotide"
tggucuuucacuuucuugggcu

SEQ ID NO: 798 - DNA, 22 bp, artificial sequence
  antisense strand of an RNAi agent
  modified_base 1,3,5,7,9,11,13,14,17,19: /mod_base = "2'-deoxy-2'-fluoro corresponding nucleoside"
  modified_base 2,4,6,8,10,12,15,16,18,20,21,22: /mod_base = "2'-O-methyl corresponding nucleoside"
ggucuuucacuuucuugggcuc

SEQ ID NO: 799 - DNA, 22 bp, artificial sequence
  antisense strand of an RNAi agent
  modified_base 1: 5' phosphorylated nucleotide"
  modified_base 1,3,5,7,9,11,13,14,17,19: /mod_base = "2'-deoxy-2'-fluoro corresponding nucleoside"
  modified_base 2,4,6,8,10,12,15,16,18,20,21,22: /mod_base = "2'-O-methyl corresponding nucleoside"
ggucuuucacuuucuugggcuc

SEQ ID NO: 800 - DNA, 26 bp, artificial sequence
  antisense strand of an RNAi agent
  modified_base 2,5,6,8,10,14: /mod_base = "2'-deoxy-2'-fluoro corresponding nucleoside"
  modified_base 1,3,4,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 801 - DNA, 26 bp, artificial sequence
  antisense strand of an RNAi agent
  modified_base 2,5,6,8,10,14: /mod_base = "2'-deoxy-2'-fluoro corresponding nucleoside"
  modified_base 1,3,4,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 802 - DNA, 26 bp, artificial sequence
  antisense strand of an RNAi agent
  modified_base 2: /mod_base = "2'-hydroxy corresponding nucleoside"
  modified_base 4,7,8,10,12,16: /mod_base = "2'-deoxy-2'-fluoro corresponding nucleoside"
  modified_base 1,3,5,6,9,11,13,14,15,17,18,19,20,21,22,23,24,25,26: /mod_base = "2'-O-methyl corresponding nucleoside"
  modified_base 4,5,24,25: /mod_base = "5'-phosphorothioate corresponding nucleotide"
uauggucuuucacuuucuugggcucu

SEQ ID NO: 803 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ucuuucacuuucuugggnn

SEQ ID NO: 804 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end (PaZ) modification"
ucuuucacuuucuugggnn

SEQ ID NO: 805 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3,19: /mod_base = "5'-phosphorothioate corresponding nucleotide"
ucuuucacuuucuugggnn

SEQ ID NO: 806 - DNA, 18 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "abasic corresponding nucleoside"
  modified_base 2,3: /mod_base = "5'-phosphorothioate corresponding nucleotide"
  modified_base 18: /mod_base = "3' end thioate(PaZ) modification"
ucuuucacuuucuugggn

SEQ ID NO: 807 - DNA, 17 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 2,3,17: /mod_base = "5'-phosphorothioate corresponding nucleotide"
  modified_base 17: /mod_base = "3' end thioate(PaZ) modification"
ucuuucacuuucuuggg

SEQ ID NO: 808 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ucuuucacuuucuugggnn

SEQ ID NO: 809 - DNA, 17 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 2,3: /mod_base = "5'-phosphorothioate corresponding nucleotide"
  modified_base 17: /mod_base = "3' end (c3)(c3)s(PaZ) modification"
ucuuucacuuucuuggg

SEQ ID NO: 810 - DNA, 17 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 2,3: /mod_base = "5'-phosphorothioate corresponding nucleotide"
  modified_base 17: /mod_base = "3' end (Sp9)s(PaZ) modification"
ucuuucacuuucuuggg

SEQ ID NO: 811 - DNA, 17 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 2,3: /mod_base = "5'-phosphorothioate corresponding nucleotide"
  modified_base 17: /mod_base = "3' end (Sp18)s(PaZ) modification"
ucuuucacuuucuuggg

SEQ ID NO: 812 - DNA, 17 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 2,3: /mod_base = "5'-phosphorothioate corresponding nucleotide"
  modified_base 17: /mod_base = "3' end (c12)s(PaZ) modification"
ucuuucacuuucuuggg

SEQ ID NO: 813 - DNA, 17 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 2,3: /mod_base = "5'-phosphorothioate corresponding nucleotide"
  modified_base 17: /mod_base = "3' end (c3)s(PaZ) modification"
ucuuucacuuucuuggg

SEQ ID NO: 814 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end (PaZ) modification"
ucuuucacuuucuugggnn

SEQ ID NO: 815 - DNA, 19 bp, artificial sequence
  antisense strand of an RNAi agent
  modified_base 2,6,8,12,14: /mod_base = "2'-deoxy-2'-fluoro corresponding nucleoside"
  modified_base 1,3,4,5,7,9,10,11,13,15,16,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
ucuuucacuuucuugggnn

SEQ ID NO: 816 - DNA, 19 bp, artificial sequence
  antisense strand of an RNAi agent
  modified_base 2,4,6,8,14: /mod_base = "2'-deoxy-2'-fluoro corresponding nucleoside"
  modified_base 1,3,5,7,9,10,11,12,13,15,16,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uggucuuucacuuucuunn

SEQ ID NO: 817 - DNA, 19 bp, artificial sequence
  antisense strand of an RNAi agent
  modified_base 2,10,12,14,16: /mod_base = "2'-deoxy-2'-fluoro corresponding nucleoside"
  modified_base 1,3,4,5,6,7,8,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
uggucuuucacuuucuunn

SEQ ID NO: 818 - DNA, 21 bp, artificial sequence
  antisense strand of an RNAi agent
  modified_base 2,4,6,8,10,12,14,15,18,20: /mod_base = "2'-deoxy-2'-fluoro corresponding nucleoside"
  modified_base 3,5,7,9,11,13,16,17,19,21: /mod_base = "2'-O-methyl corresponding nucleoside"
  modified_base 2: /mod_base = "5'-phosphorothioate corresponding nucleotide"
tggucuuucacuuucuugggc

SEQ ID NO: 819 - DNA, 21 bp, artificial sequence
  antisense strand of an RNAi agent
  modified_base 1: 5' phosphorylated nucleotide"
  modified_base 2,4,6,8,10,12,14,15,18,20: /mod_base = "2'-deoxy-2'-fluoro corresponding nucleoside"
  modified_base 3,5,7,9,11,13,16,17,19,21: /mod_base = "2'-O-methyl corresponding nucleoside"
  modified_base 2: /mod_base = "5'-phosphorothioate corresponding nucleotide"
tggucuuucacuuucuugggc

SEQ ID NO: 820 - DNA, 26 bp, artificial sequence
  antisense strand of an RNAi agent
  modified_base 2: /mod_base = "2'-hydroxy corresponding nucleoside"
  modified_base 4,10,12,16: /mod_base = "2'-deoxy-2'-fluoro corresponding nucleoside"
  modified_base 1,3,5,6,7,8,9,11,13,14,15,17,18,19,20,21,22,23,24,25,26: /mod_base = "2'-O-methyl corresponding nucleoside"
  modified_base 4,5,24,25: /mod_base = "5'-phosphorothioate corresponding nucleotide"
uauggucuuucacuuucuugggcucu

SEQ ID NO: 821 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 2,3,21,22: /mod_base = "5'-phosphorothioate corresponding nucleotide"
uggucuuucacuuucuugggcucuau

SEQ ID NO: 822 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 2,3,20,21: /mod_base = "5'-phosphorothioate corresponding nucleotide"
uggucuuucacuuucuugggcucuau

SEQ ID NO: 823 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 2,3,23: /mod_base = "5'-phosphorothioate corresponding nucleotide"
uggucuuucacuuucuugggcucuau

SEQ ID NO: 824 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 2,22,23: /mod_base = "5'-phosphorothioate corresponding nucleotide"
uggucuuucacuuucuugggcucuau

SEQ ID NO: 825 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 2,23: /mod_base = "5'-phosphorothioate corresponding nucleotide"
uggucuuucacuuucuugggcucuau

SEQ ID NO: 826 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 3,4,5,6,7,9,11,12,13,15,16,17,18,19,20,21,22,23,24,26: /mod_base = "2'-O-methyl corresponding nucleoside"
  modified_base 1: /mod_base = "5'-vinyl phosphonate nucleotide"
  modified_base 3,22,23: /mod_base = "5'-phosphorothioate corresponding nucleotide"
tggucuuucacuuucuugggcucuau

SEQ ID NO: 827 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 3,4,5,6,7,9,11,12,13,15,16,17,18,19,20,21,22,23,24,26: /mod_base = "2'-O-methyl corresponding nucleoside"
  modified_base 1: /mod_base = "5'-vinyl phosphonate nucleotide"
  modified_base 2,3,22,23: /mod_base = "5'-phosphorothioate corresponding nucleotide"
tggucuuucacuuucuugggcucuau

SEQ ID NO: 828 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 3,4,5,6,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
tggucuuucacuuucuugggcucuau

SEQ ID NO: 829 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcuucau

SEQ ID NO: 830 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 831 - DNA, 26 bp, artificial sequence
  antisense strand of an RNAi agent
  modified_base 25: /mod_base = "2'-hydroxy corresponding nucleoside"
  modified_base 2,4,6,8,10,12,14,15,18,20: /mod_base = "2'-deoxy-2'-fluoro corresponding nucleoside"
  modified_base 3,5,7,9,11,13,16,17,19,21,22,23,24,26: /mod_base = "2'-O-methyl corresponding nucleoside"
  modified_base 2: /mod_base = "5'-phosphorothioate corresponding nucleotide"
tggucuuucacuuucuugggcauaua

SEQ ID NO: 832 - DNA, 26 bp, artificial sequence
  antisense strand of an RNAi agent
  modified_base 2,4,6,8,10,12,14,15,18,20: /mod_base = "2'-deoxy-2'-fluoro corresponding nucleoside"
  modified_base 3,5,7,9,11,13,16,17,19,21,22,23,24,25,26: /mod_base = "2'-O-methyl corresponding nucleoside"
  modified_base 2: /mod_base = "5'-phosphorothioate corresponding nucleotide"
tggucuuucacuuucuugggcucuau

SEQ ID NO: 833 - DNA, 26 bp, artificial sequence
  antisense strand of an RNAi agent
  modified_base 3: /mod_base = "2'-hydroxy corresponding nucleoside"
  modified_base 5,11,13,17: /mod_base = "2'-deoxy-2'-fluoro corresponding nucleoside"
  modified_base 1,2,4,6,7,8,9,10,12,14,15,16,18,19,20,21,22,23,24,25,26: /mod_base = "2'-O-methyl corresponding nucleoside"
  modified_base 5,6,25,26: /mod_base = "5'-phosphorothioate corresponding nucleotide"
uuauggucuuucacuuucuugggcuc

SEQ ID NO: 834 - DNA, 26 bp, artificial sequence
  antisense strand of an RNAi agent
  modified_base 2,3: /mod_base = "2'-hydroxy corresponding nucleoside"
  modified_base 5,11,13,17: /mod_base = "2'-deoxy-2'-fluoro corresponding nucleoside"
  modified_base 1,4,6,7,8,9,10,12,14,15,16,18,19,20,21,22,23,24,25,26: /mod_base = "2'-O-methyl corresponding nucleoside"
  modified_base 5,6,25,26: /mod_base = "5'-phosphorothioate corresponding nucleotide"
ugauggucuuucacuuucuugggcuc

SEQ ID NO: 835 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
  modified_base 1: /mod_base = "5' end (NH2-c6) modification"
uggucuuucacuuucuugggcucuau

SEQ ID NO: 836 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
  modified_base 1: /mod_base = "5' end (cy5-c6) modification"
uggucuuucacuuucuugggcucuau

SEQ ID NO: 837 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cccuggugugcuaccaccat

SEQ ID NO: 838 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccuggugugcuaccacccat

SEQ ID NO: 839 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cuggugugcuaccaccccat

SEQ ID NO: 840 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uuggagcccaagaaagugat

SEQ ID NO: 841 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uggagcccaagaaagugaat

SEQ ID NO: 842 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggagcccaagaaagugaaat

SEQ ID NO: 843 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gagcccaagaaagugaaaat

SEQ ID NO: 844 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
agcccaagaaagugaaagat

SEQ ID NO: 845 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gcccaagaaagugaaagaat

SEQ ID NO: 846 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cccaagaaagugaaagacat

SEQ ID NO: 847 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccaagaaagugaaagaccat

SEQ ID NO: 848 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
caagaaagugaaagaccaat

SEQ ID NO: 849 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gugcuuugagccucagcuat

SEQ ID NO: 850 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ugcuuugagccucagcuuat

SEQ ID NO: 851 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gcuuugagccucagcuucat

SEQ ID NO: 852 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uuugagccucagcuucucat

SEQ ID NO: 853 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cuggccagccaggccugcat

SEQ ID NO: 854 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccaccaguucgagggggcat

SEQ ID NO: 855 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gggcuguggugaccgcaaat

SEQ ID NO: 856 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggcuguggugaccgcaacat

SEQ ID NO: 857 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gcuguggugaccgcaacaat

SEQ ID NO: 858 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cuguggugaccgcaacaaat

SEQ ID NO: 859 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uguggugaccgcaacaagat

SEQ ID NO: 860 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
guggugaccgcaacaagcat

SEQ ID NO: 861 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uggugaccgcaacaagccat

SEQ ID NO: 862 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gaacucaauaaagugcuuat

SEQ ID NO: 863 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
aacucaauaaagugcuuuat

SEQ ID NO: 864 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
acucaauaaagugcuuugat

SEQ ID NO: 865 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cucaauaaagugcuuugaat

SEQ ID NO: 866 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ucaauaaagugcuuugaaat

SEQ ID NO: 867 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
caauaaagugcuuugaaaat

SEQ ID NO: 868 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
aauaaagugcuuugaaaaat

SEQ ID NO: 869 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uggaccaacggacggaugat

SEQ ID NO: 870 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggaccaacggacggaugcat

SEQ ID NO: 871 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gaccaacggacggaugccat

SEQ ID NO: 872 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
accaacggacggaugccaat

SEQ ID NO: 873 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccaacggacggaugccauat

SEQ ID NO: 874 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
caacggacggaugccaugat

SEQ ID NO: 875 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
aacggacggaugccaugaat

SEQ ID NO: 876 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
acggacggaugccaugagat

SEQ ID NO: 877 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gaugccaugagggcucugat

SEQ ID NO: 878 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
augccaugagggcucugcat

SEQ ID NO: 879 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cucugcugcuccugggguat

SEQ ID NO: 880 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggagcccugccacuucccat

SEQ ID NO: 881 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccaccggcagcuguaccaat

SEQ ID NO: 882 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
aacuuugaucaggaccagat

SEQ ID NO: 883 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
acuuugaucaggaccagcat

SEQ ID NO: 884 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uuugaucaggaccagcgaat

SEQ ID NO: 885 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gaucaggaccagcgauggat

SEQ ID NO: 886 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
aucaggaccagcgaugggat

SEQ ID NO: 887 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
caggaccagcgauggggaat

SEQ ID NO: 888 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
guuuggagcccaagaaagat

SEQ ID NO: 889 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uuuggagcccaagaaaguat

SEQ ID NO: 890 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ugauggccgcgggcucagat

SEQ ID NO: 891 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ucagccgugggccucggaat

SEQ ID NO: 892 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cagccgugggccucggagat

SEQ ID NO: 893 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
agccgugggccucggaggat

SEQ ID NO: 894 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ugggccucggaggccaccat

SEQ ID NO: 895 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gggccucggaggccaccuat

SEQ ID NO: 896 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggccucggaggccaccuaat

SEQ ID NO: 897 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gccucggaggccaccuacat

SEQ ID NO: 898 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
aagcgcggaacuggggacat

SEQ ID NO: 899 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccacgccuucugccggaaat

SEQ ID NO: 900 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cacgccuucugccggaacat

SEQ ID NO: 901 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
acgccuucugccggaaccat

SEQ ID NO: 902 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccuucugccggaacccggat

SEQ ID NO: 903 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cuucugccggaacccggaat

SEQ ID NO: 904 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uucugccggaacccggacat

SEQ ID NO: 905 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ucugccggaacccggacaat

SEQ ID NO: 906 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gccggaacccggacaacgat

SEQ ID NO: 907 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccggaacccggacaacgaat

SEQ ID NO: 908 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gccuucccugaccaggaaat

SEQ ID NO: 909 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccuucccugaccaggaacat

SEQ ID NO: 910 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cuucccugaccaggaacgat

SEQ ID NO: 911 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uucccugaccaggaacggat

SEQ ID NO: 912 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ucccugaccaggaacggcat

SEQ ID NO: 913 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
accaggaacggcccacugat

SEQ ID NO: 914 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggaacggcccacugagcuat

SEQ ID NO: 915 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccgcaagagucugucuucat

SEQ ID NO: 916 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
acaguuucugcgccggcaat

SEQ ID NO: 917 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gccggcagccucaucgccat

SEQ ID NO: 918 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccggcagccucaucgcccat

SEQ ID NO: 919 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cggcagccucaucgccccat

SEQ ID NO: 920 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
caucgcccccugcuggguat

SEQ ID NO: 921 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ucgcccccugcugggugcat

SEQ ID NO: 922 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cgcccccugcugggugcuat

SEQ ID NO: 923 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cccccugcugggugcugaat

SEQ ID NO: 924 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ucugacgguggugcucggat

SEQ ID NO: 925 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ugacgguggugcucggccat

SEQ ID NO: 926 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gacgguggugcucggccaat

SEQ ID NO: 927 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gguggugcucggccaggaat

SEQ ID NO: 928 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggaugcggacggcagcugat

SEQ ID NO: 929 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
acggcagcugcgcgcuccat

SEQ ID NO: 930 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gcuccugucgccuuacguat

SEQ ID NO: 931 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cugucgccuuacguucagat

SEQ ID NO: 932 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggcggaggaauaugccagat

SEQ ID NO: 933 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cggaggaauaugccagcuat

SEQ ID NO: 934 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gaggaauaugccagcuucat

SEQ ID NO: 935 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
aggaauaugccagcuuccat

SEQ ID NO: 936 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggugauuccggaggcccgat

SEQ ID NO: 937 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccgcagugagagaguggcat

SEQ ID NO: 938 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cgcagugagagaguggcuat

SEQ ID NO: 939 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cgccaugacggcucuguuat

SEQ ID NO: 940 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gccaugacggcucuguugat

SEQ ID NO: 941 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccaugacggcucuguuguat

SEQ ID NO: 942 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
caugacggcucuguuguuat

SEQ ID NO: 943 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
augacggcucuguuguucat

SEQ ID NO: 944 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ugacggcucuguuguuccat

SEQ ID NO: 945 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ucccuuucaguaccaccgat

SEQ ID NO: 946 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccacaaaugcauccacaaat

SEQ ID NO: 947 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
caauggggauacugcuugat

SEQ ID NO: 948 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uggggauacugcuuggagat

SEQ ID NO: 949 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggggauacugcuuggagcat

SEQ ID NO: 950 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggauacugcuuggagcccat

SEQ ID NO: 951 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gaccauugcagcaaacacat

SEQ ID NO: 952 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggaggccaccuaccggaaat

SEQ ID NO: 953 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gaggccaccuaccggaacat

SEQ ID NO: 954 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
aggccaccuaccggaacaat

SEQ ID NO: 955 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uaccggaacaugacugagat

SEQ ID NO: 956 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cagauaaugacacacgucat

SEQ ID NO: 957 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
agauaaugacacacguccat

SEQ ID NO: 958 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gauaaugacacacguccaat

SEQ ID NO: 959 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
auaaugacacacguccauat

SEQ ID NO: 960 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
augacacacguccaugguat

SEQ ID NO: 961 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gcgcguggugggcggacuat

SEQ ID NO: 962 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cgcguggugggcggacuaat

SEQ ID NO: 963 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gcguggugggcggacuagat

SEQ ID NO: 964 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cguggugggcggacuaguat

SEQ ID NO: 965 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggcggacuaguggcucugat

SEQ ID NO: 966 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggccagcgcccgaggaacat

SEQ ID NO: 967 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ggaacugacagugguacuat

SEQ ID NO: 968 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
agugguacuuggucaagaat

SEQ ID NO: 969 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ugguacuuggucaagaucat

SEQ ID NO: 970 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
gguacuuggucaagaucgat

SEQ ID NO: 971 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
uacuuggucaagaucgccat

SEQ ID NO: 972 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cuccuaccgccuucacgaat

SEQ ID NO: 973 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccuaccgccuucacgaggat

SEQ ID NO: 974 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cuaccgccuucacgagggat

SEQ ID NO: 975 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cugagacagugcucugcgat

SEQ ID NO: 976 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
aguucgagggggcugaagat

SEQ ID NO: 977 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
guucgagggggcugaagaat

SEQ ID NO: 978 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ucgagggggcugaagaauat

SEQ ID NO: 979 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cucuaacgugcacggagaat

SEQ ID NO: 980 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
cuaacgugcacggagacgat

SEQ ID NO: 981 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
acgugcacggagacgccaat

SEQ ID NO: 982 - DNA, 23 bp, artificial sequence
  sense strand of an RNAi agent
  modified_base 2: /mod_base = "2'-hydroxy corresponding nucleoside"
  modified_base 4,6,8,10,12,14,16,18,20,22: /mod_base = "2'-deoxy-2'-fluoro corresponding nucleoside"
  modified_base 1,3,5,7,9,11,13,15,17,19,21: /mod_base = "2'-O-methyl corresponding nucleoside"
  modified_base 23: /mod_base = "3'-3'-linked nucleotide"
  modified_base 1: /mod_base = "5' end (chol-tEg) modification"
uauagcccaagaaagugaaagat

SEQ ID NO: 983 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
agcccaagaaagugaaagut

SEQ ID NO: 984 - DNA, 23 bp, artificial sequence
  sense strand of an RNAi agent
  modified_base 2: /mod_base = "2'-hydroxy corresponding nucleoside"
  modified_base 4,6,8,10,12,14,16,18,20,22: /mod_base = "2'-deoxy-2'-fluoro corresponding nucleoside"
  modified_base 1,3,5,7,9,11,13,15,17,19,21: /mod_base = "2'-O-methyl corresponding nucleoside"
  modified_base 23: /mod_base = "3'-3'-linked nucleotide"
  modified_base 1: /mod_base = "5' end (chol-tEg) modification"
uaugcccaagaaagugaaagaat

SEQ ID NO: 985 - DNA, 23 bp, artificial sequence
  sense strand of an RNAi agent
  modified_base 2: /mod_base = "2'-hydroxy corresponding nucleoside"
  modified_base 4,6,8,10,12,14,16,18,20,22: /mod_base = "2'-deoxy-2'-fluoro corresponding nucleoside"
  modified_base 1,3,5,7,9,11,13,15,17,19,21: /mod_base = "2'-O-methyl corresponding nucleoside"
  modified_base 23: /mod_base = "3'-3'-linked nucleotide"
  modified_base 1: /mod_base = "5' end (chol-tEg) modification"
uaucccaagaaagugaaagacat

SEQ ID NO: 986 - DNA, 23 bp, artificial sequence
  sense strand of an RNAi agent
  modified_base 2: /mod_base = "2'-hydroxy corresponding nucleoside"
  modified_base 4,6,8,10,12,14,16,18,20,22: /mod_base = "2'-deoxy-2'-fluoro corresponding nucleoside"
  modified_base 1,3,5,7,9,11,13,15,17,19,21: /mod_base = "2'-O-methyl corresponding nucleoside"
  modified_base 23: /mod_base = "3'-3'-linked nucleotide"
  modified_base 1: /mod_base = "5' end (chol-tEg) modification"
uauccaagaaagugaaagaccat

SEQ ID NO: 987 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
ccaagaaagugaaagaccut

SEQ ID NO: 988 - DNA, 23 bp, artificial sequence
  sense strand of an RNAi agent
  modified_base 2: /mod_base = "2'-hydroxy corresponding nucleoside"
  modified_base 4,6,8,10,12,14,16,18,20,22: /mod_base = "2'-deoxy-2'-fluoro corresponding nucleoside"
  modified_base 1,3,5,7,9,11,13,15,17,19,21: /mod_base = "2'-O-methyl corresponding nucleoside"
  modified_base 23: /mod_base = "3'-3'-linked nucleotide"
  modified_base 1: /mod_base = "5' end (chol-tEg) modification"
uaucaagaaagugaaagaccaat

SEQ ID NO: 989 - DNA, 23 bp, artificial sequence
  sense strand of an RNAi agent
  modified_base 2: /mod_base = "2'-hydroxy corresponding nucleoside"
  modified_base 4,6,8,10,12,14,16,18,20,22: /mod_base = "2'-deoxy-2'-fluoro corresponding nucleoside"
  modified_base 1,3,5,7,9,11,13,15,17,19,21: /mod_base = "2'-O-methyl corresponding nucleoside"
  modified_base 23: /mod_base = "3'-3'-linked nucleotide"
  modified_base 1: /mod_base = "5' end (chol-tEg) modification"
uauuuugagccucagcuucucat

SEQ ID NO: 990 - DNA, 23 bp, artificial sequence
  sense strand of an RNAi agent
  modified_base 2: /mod_base = "2'-hydroxy corresponding nucleoside"
  modified_base 4,6,8,10,12,14,16,18,20,22: /mod_base = "2'-deoxy-2'-fluoro corresponding nucleoside"
  modified_base 1,3,5,7,9,11,13,15,17,19,21: /mod_base = "2'-O-methyl corresponding nucleoside"
  modified_base 23: /mod_base = "3'-3'-linked nucleotide"
  modified_base 21,22: /mod_base = "5'-phosphorothioate corresponding nucleotide"
  modified_base 1: /mod_base = "5' end (chol-tEg) modification"
uaucccaagaaagugaaagacat

SEQ ID NO: 991 - DNA, 23 bp, artificial sequence
  sense strand of an RNAi agent
  modified_base 2: /mod_base = "2'-hydroxy corresponding nucleoside"
  modified_base 4,6,8,10,12,14,16,18,20,22: /mod_base = "2'-deoxy-2'-fluoro corresponding nucleoside"
  modified_base 1,3,5,7,9,11,13,15,17,19,21: /mod_base = "2'-O-methyl corresponding nucleoside"
  modified_base 23: /mod_base = "3'-3'-linked nucleotide"
  modified_base 21,22: /mod_base = "5'-phosphorothioate corresponding nucleotide"
  modified_base 1: /mod_base = "5' end (chol-tEg) modification"
uauccaagaaagugaaagaccat

SEQ ID NO: 992 - DNA, 23 bp, artificial sequence
  sense strand of an RNAi agent
  modified_base 2: /mod_base = "2'-hydroxy corresponding nucleoside"
  modified_base 4,6,8,10,12,14,16,18,20,22: /mod_base = "2'-deoxy-2'-fluoro corresponding nucleoside"
  modified_base 1,3,5,7,9,11,13,15,17,19,21: /mod_base = "2'-O-methyl corresponding nucleoside"
  modified_base 23: /mod_base = "3'-3'-linked nucleotide"
  modified_base 21,22: /mod_base = "5'-phosphorothioate corresponding nucleotide"
  modified_base 1: /mod_base = "5' end (chol-tEg) modification"
uauuuugagccucagcuucucat

SEQ ID NO: 993 - DNA, 23 bp, artificial sequence
  sense strand of an RNAi agent
  modified_base 2: /mod_base = "2'-hydroxy corresponding nucleoside"
  modified_base 4,6,8,10,11,12,14,16,18,20,22: /mod_base = "2'-deoxy-2'-fluoro corresponding nucleoside"
  modified_base 1,3,5,7,9,13,15,17,19,21: /mod_base = "2'-O-methyl corresponding nucleoside"
  modified_base 23: /mod_base = "3'-3'-linked nucleotide"
  modified_base 21,22: /mod_base = "5'-phosphorothioate corresponding nucleotide"
  modified_base 1: /mod_base = "5' end (chol-tEg) modification"
uaucccaagaaagugaaagacat

SEQ ID NO: 994 - DNA, 23 bp, artificial sequence
  sense strand of an RNAi agent
  modified_base 2: /mod_base = "2'-hydroxy corresponding nucleoside"
  modified_base 4,6,8,10,11,12,14,16,18,20,22: /mod_base = "2'-deoxy-2'-fluoro corresponding nucleoside"
  modified_base 1,3,5,7,9,13,15,17,19,21: /mod_base = "2'-O-methyl corresponding nucleoside"
  modified_base 23: /mod_base = "3'-3'-linked nucleotide"
  modified_base 21,22: /mod_base = "5'-phosphorothioate corresponding nucleotide"
  modified_base 1: /mod_base = "5' end (chol-tEg) modification"
uauccaagaaagugaaagaccat

SEQ ID NO: 995 - DNA, 23 bp, artificial sequence
  sense strand of an RNAi agent
  modified_base 2: /mod_base = "2'-hydroxy corresponding nucleoside"
  modified_base 4,6,8,10,11,12,14,16,18,20,22: /mod_base = "2'-deoxy-2'-fluoro corresponding nucleoside"
  modified_base 1,3,5,7,9,13,15,17,19,21: /mod_base = "2'-O-methyl corresponding nucleoside"
  modified_base 23: /mod_base = "3'-3'-linked nucleotide"
  modified_base 21,22: /mod_base = "5'-phosphorothioate corresponding nucleotide"
  modified_base 1: /mod_base = "5' end (chol-tEg) modification"
uauuuugagccucagcuucucat

SEQ ID NO: 996 - DNA, 25 bp, artificial sequence
  sense strand of an RNAi agent
  modified_base 24: /mod_base = "2'-hydroxy corresponding nucleoside"
  modified_base 1,3,5,7,9,10,11,13,15,17,19,21: /mod_base = "2'-deoxy-2'-fluoro corresponding nucleoside"
  modified_base 2,4,6,8,12,14,16,18,20,23,25: /mod_base = "2'-O-methyl corresponding nucleoside"
  modified_base 22: /mod_base = "abasic corresponding nucleoside"
  modified_base 2,3: /mod_base = "5'-phosphorothioate corresponding nucleotide"
  modified_base 25: /mod_base = "3' end (tEg-chol) modification"
gcccaagaaagugaaagaccanuau

SEQ ID NO: 997 - DNA, 23 bp, artificial sequence
  sense strand of an RNAi agent
  modified_base 2: /mod_base = "2'-hydroxy corresponding nucleoside"
  modified_base 4,6,8,10,11,12,14,16,18,20,22: /mod_base = "2'-deoxy-2'-fluoro corresponding nucleoside"
  modified_base 1,3,5,7,9,13,15,17,19,21: /mod_base = "2'-O-methyl corresponding nucleoside"
  modified_base 23: /mod_base = "3'-3'-linked nucleotide"
  modified_base 1: /mod_base = "5' end (chol-tEg) modification"
uauccaagaaagugaaagaccat

SEQ ID NO: 998 - DNA, 23 bp, artificial sequence
  sense strand of an RNAi agent
  modified_base 2: /mod_base = "2'-hydroxy corresponding nucleoside"
  modified_base 4,6,8,10,11,12,14,16,18,20,22: /mod_base = "2'-deoxy-2'-fluoro corresponding nucleoside"
  modified_base 1,3,5,7,9,13,15,17,19,21: /mod_base = "2'-O-methyl corresponding nucleoside"
  modified_base 23: /mod_base = "3'-3'-linked nucleotide"
  modified_base 1: /mod_base = "5' end (chol-tEg) modification"
uaucccaagaaagugaaagacat

SEQ ID NO: 999 - DNA, 23 bp, artificial sequence
  sense strand of an RNAi agent
  modified_base 2: /mod_base = "2'-hydroxy corresponding nucleoside"
  modified_base 4,6,8,10,11,12,14,16,18,20,22: /mod_base = "2'-deoxy-2'-fluoro corresponding nucleoside"
  modified_base 1,3,5,7,9,13,15,17,19,21: /mod_base = "2'-O-methyl corresponding nucleoside"
  modified_base 23: /mod_base = "3'-3'-linked nucleotide"
  modified_base 1: /mod_base = "5' end (chol-tEg) modification"
uauuuugagccucagcuucucat

SEQ ID NO: 1000 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
  modified_base 1: /mod_base = "5' end (alk-SS-c6) modification"
ccaagaaagugaaagaccat

SEQ ID NO: 1001 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
  modified_base 20: /mod_base = "3'-3'-linked nucleotide"
  modified_base 1: /mod_base = "5' end (NH2-c6) modification"
ccaagaaagugaaagaccat

SEQ ID NO: 1002 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-SS-c6)(tEg-chol) modification"
uauaugcccaagaaagugaaagacca

SEQ ID NO: 1003 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1004 - DNA, 22 bp, artificial sequence
  sense strand of an RNAi agent
  modified_base 2,4,6,8,10,11,12,14,16,18,20,22: /mod_base = "2'-deoxy-2'-fluoro corresponding nucleoside"
  modified_base 1,3,5,7,9,13,15,17,19,21: /mod_base = "2'-O-methyl corresponding nucleoside"
  modified_base 2,3: /mod_base = "5'-phosphorothioate corresponding nucleotide"
  modified_base 22: /mod_base = "3' end (c6-SS-c6)(tEg-chol) modification"
ugcccaagaaagugaaagacca

SEQ ID NO: 1005 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-SS-c6)(tEg-chol) modification"
gcccaagaaagugaaagacca

SEQ ID NO: 1006 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 6,7: /mod_base = "5'-phosphorothioate corresponding nucleotide"
  modified_base 1: /mod_base = "5' end (chol-tEg) modification"
uauaugcccaagaaagugaaagacca

SEQ ID NO: 1007 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-NH2) modification"
ggagcccaagaaagugaaaga

SEQ ID NO: 1008 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-NH2) modification"
gagcccaagaaagugaaagaa

SEQ ID NO: 1009 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-NH2) modification"
agcccaagaaagugaaagaca

SEQ ID NO: 1010 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-NH2) modification"
gcccaagaaagugaaagacca

SEQ ID NO: 1011 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-NH2) modification"
cccaagaaagugaaagaccaa

SEQ ID NO: 1012 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-NH2) modification"
gcuuugagccucagcuucuca

SEQ ID NO: 1013 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-NH2) modification"
uauaugcccaagaaagugaaagacca

SEQ ID NO: 1014 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-SS-alk-Me) modification"
ggagcccaagaaagugaaaga

SEQ ID NO: 1015 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-SS-alk-Me) modification"
gagcccaagaaagugaaagaa

SEQ ID NO: 1016 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-SS-alk-Me) modification"
agcccaagaaagugaaagaca

SEQ ID NO: 1017 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-SS-alk-Me) modification"
gcccaagaaagugaaagacca

SEQ ID NO: 1018 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-SS-alk-Me) modification"
cccaagaaagugaaagaccaa

SEQ ID NO: 1019 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-SS-alk-Me) modification"
gcuuugagccucagcuucuca

SEQ ID NO: 1020 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-SS-alk-Me) modification"
uauaugcccaagaaagugaaagacca

SEQ ID NO: 1021 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (Nag3) modification"
uauaugcccaagaaagugaaagacca

SEQ ID NO: 1022 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c11-Nag3) modification"
uauaugcccaagaaagugaaagacca

SEQ ID NO: 1023 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1024 - DNA, 26 bp, artificial sequence
  sense strand of an RNAi agent
  modified_base 2,4: /mod_base = "2'-hydroxy corresponding nucleoside"
  modified_base 6,8,10,12,15,16,18,20,22,24,26: /mod_base = "2'-deoxy-2'-fluoro corresponding nucleoside"
  modified_base 1,3,5,7,9,11,13,14,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1025 - DNA, 26 bp, artificial sequence
  sense strand of an RNAi agent
  modified_base 2,4: /mod_base = "2'-hydroxy corresponding nucleoside"
  modified_base 6,8,10,12,13,15,16,18,20,22,24,26: /mod_base = "2'-deoxy-2'-fluoro corresponding nucleoside"
  modified_base 1,3,5,7,9,11,14,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1026 - DNA, 26 bp, artificial sequence
  sense strand of an RNAi agent
  modified_base 2,4: /mod_base = "2'-hydroxy corresponding nucleoside"
  modified_base 7,9,11,13,15,16,18,20,22,24,26: /mod_base = "2'-deoxy-2'-fluoro corresponding nucleoside"
  modified_base 1,3,5,6,8,10,12,14,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1027 - DNA, 26 bp, artificial sequence
  sense strand of an RNAi agent
  modified_base 2,4: /mod_base = "2'-hydroxy corresponding nucleoside"
  modified_base 19: /mod_base = "2'-3' seco corresponding nucleotide"
  modified_base 6,8,10,12,14,16,18,20,22,24,26: /mod_base = "2'-deoxy-2'-fluoro corresponding nucleoside"
  modified_base 1,3,5,7,9,11,13,15,17,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1028 - DNA, 26 bp, artificial sequence
  sense strand of an RNAi agent
  modified_base 2,4: /mod_base = "2'-hydroxy corresponding nucleoside"
  modified_base 18: /mod_base = "2'-3' seco corresponding nucleotide"
  modified_base 6,8,10,12,14,16,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1029 - DNA, 26 bp, artificial sequence
  sense strand of an RNAi agent
  modified_base 2,4: /mod_base = "2'-hydroxy corresponding nucleoside"
  modified_base 17: /mod_base = "2'-3' seco corresponding nucleotide"
  modified_base 6,8,10,12,14,16,18,20,22,24,26: /mod_base = "2'-deoxy-2'-fluoro corresponding nucleoside"
  modified_base 1,3,5,7,9,11,13,15,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1030 - DNA, 26 bp, artificial sequence
  sense strand of an RNAi agent
  modified_base 2,4: /mod_base = "2'-hydroxy corresponding nucleoside"
  modified_base 16: /mod_base = "2'-3' seco corresponding nucleotide"
  modified_base 6,8,10,12,14,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1031 - DNA, 26 bp, artificial sequence
  sense strand of an RNAi agent
  modified_base 2,4: /mod_base = "2'-hydroxy corresponding nucleoside"
  modified_base 15: /mod_base = "2'-3' seco corresponding nucleotide"
  modified_base 6,8,10,12,14,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1032 - DNA, 26 bp, artificial sequence
  sense strand of an RNAi agent
  modified_base 2,4: /mod_base = "2'-hydroxy corresponding nucleoside"
  modified_base 14: /mod_base = "2'-3' seco corresponding nucleotide"
  modified_base 6,8,10,12,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1033 - DNA, 26 bp, artificial sequence
  sense strand of an RNAi agent
  modified_base 2,4: /mod_base = "2'-hydroxy corresponding nucleoside"
  modified_base 13: /mod_base = "2'-3' seco corresponding nucleotide"
  modified_base 6,8,10,12,14,16,18,20,22,24,26: /mod_base = "2'-deoxy-2'-fluoro corresponding nucleoside"
  modified_base 1,3,5,7,9,11,15,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1034 - DNA, 26 bp, artificial sequence
  sense strand of an RNAi agent
  modified_base 2,4: /mod_base = "2'-hydroxy corresponding nucleoside"
  modified_base 12: /mod_base = "2'-3' seco corresponding nucleotide"
  modified_base 6,8,10,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcccaagaaagugaaagacca

SEQ ID NO: 1035 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcuuugagccucagcuucuca

SEQ ID NO: 1036 - DNA, 26 bp, artificial sequence
  sense strand of an RNAi agent
  modified_base 2,4: /mod_base = "2'-hydroxy corresponding nucleoside"
  modified_base 6,8,10,12,15,16,18,20,22,24,26: /mod_base = "2'-deoxy-2'-fluoro corresponding nucleoside"
  modified_base 1,3,5,7,9,11,13,14,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcuuugagccucagcuucuca

SEQ ID NO: 1037 - DNA, 26 bp, artificial sequence
  sense strand of an RNAi agent
  modified_base 2,4: /mod_base = "2'-hydroxy corresponding nucleoside"
  modified_base 6,8,10,12,13,15,16,18,20,22,24,26: /mod_base = "2'-deoxy-2'-fluoro corresponding nucleoside"
  modified_base 1,3,5,7,9,11,14,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcuuugagccucagcuucuca

SEQ ID NO: 1038 - DNA, 26 bp, artificial sequence
  sense strand of an RNAi agent
  modified_base 2,4: /mod_base = "2'-hydroxy corresponding nucleoside"
  modified_base 7,9,11,13,14,16,18,20,22,24,26: /mod_base = "2'-deoxy-2'-fluoro corresponding nucleoside"
  modified_base 1,3,5,6,8,10,12,15,17,19,21,23,25: /mod_base = "2'-O-methyl corresponding nucleoside"
  modified_base 6,7,25,26: /mod_base = "5'-phosphorothioate corresponding nucleotide"
  modified_base 1: /mod_base = "5' end (chol-tEg) modification"
uauaugcuuugagccucagcuucuca

SEQ ID NO: 1039 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag4) modification"
uauaugcccaagaaagugaaagacca

SEQ ID NO: 1040 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 26: /mod_base = "3'-3'-linked nucleotide"
  modified_base 6,7: /mod_base = "5'-phosphorothioate corresponding nucleotide"
  modified_base 1: /mod_base = "5' end (chol-tEg) modification"
uauaugcccaagaaagugaaagacca

SEQ ID NO: 1041 - DNA, 28 bp, artificial sequence
  sense strand of an RNAi agent
  modified_base 2: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,4,5,7,9,11,13,15,17,19,21,23,25,27: /mod_base = "2'-O-methyl corresponding nucleoside"
  modified_base 28: /mod_base = "3'-3'-linked nucleotide"
  modified_base 4,5: /mod_base = "5'-phosphorothioate corresponding nucleotide"
  modified_base 1: /mod_base = "5' end (chol-tEg) modification"
uauaugagcccaagaaagugaaagacca

SEQ ID NO: 1042 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 26: /mod_base = "3'-3'-linked nucleotide"
  modified_base 6,7: /mod_base = "5'-phosphorothioate corresponding nucleotide"
  modified_base 1: /mod_base = "5' end (chol-tEg) modification"
uauaugcuuugagccucagcuucuca

SEQ ID NO: 1043 - DNA, 28 bp, artificial sequence
  sense strand of an RNAi agent
  modified_base 2: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,4,5,7,9,11,13,15,17,19,21,23,25,27: /mod_base = "2'-O-methyl corresponding nucleoside"
  modified_base 28: /mod_base = "3'-3'-linked nucleotide"
  modified_base 4,5: /mod_base = "5'-phosphorothioate corresponding nucleotide"
  modified_base 1: /mod_base = "5' end (chol-tEg) modification"
uauaugugcuuugagccucagcuucuca

SEQ ID NO: 1044 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-SMPt-alk) modification"
gcuuugagccucagcuucuca

SEQ ID NO: 1045 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-SMPt-alk) modification"
uauaugcccaagaaagugaaagacca

SEQ ID NO: 1046 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 6,7: /mod_base = "5'-phosphorothioate corresponding nucleotide"26
uauaugcccaagaaagugaaagacca

SEQ ID NO: 1047 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-NH2) modification"
uauauguuuggagcccaagaaaguga

SEQ ID NO: 1048 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-NH2) modification"
uauauuuuggagcccaagaaagugaa

SEQ ID NO: 1049 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-NH2) modification"
uauauuuggagcccaagaaagugaaa

SEQ ID NO: 1050 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-NH2) modification"
uauauuggagcccaagaaagugaaaa

SEQ ID NO: 1051 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-NH2) modification"
uauauaagugcuuugagccucagcua

SEQ ID NO: 1052 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-NH2) modification"
uauaugugcuuugagccucagcuuca

SEQ ID NO: 1053 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-NH2) modification"
uauauggcuguggugaccgcaacaaa

SEQ ID NO: 1054 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-NH2) modification"
uauaucuguggugaccgcaacaagca

SEQ ID NO: 1055 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-NH2) modification"
uauauuguggugaccgcaacaagcca

SEQ ID NO: 1056 - DNA, 26 bp, artificial sequence
  sense strand of an RNAi agent
  modified_base 2,4: /mod_base = "2'-hydroxy corresponding nucleoside"
  modified_base 6,8,10,12,15,16,18,20,22,24: /mod_base = "2'-deoxy-2'-fluoro corresponding nucleoside"
  modified_base 1,3,5,7,9,11,13,14,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
  modified_base 1: /mod_base = "5' end (chol-tEg) modification"
uauaugcccaagaaagugaaagacca

SEQ ID NO: 1057 - DNA, 26 bp, artificial sequence
  sense strand of an RNAi agent
  modified_base 2,4: /mod_base = "2'-hydroxy corresponding nucleoside"
  modified_base 6,8,10,12,15,16,18,20,22,24: /mod_base = "2'-deoxy-2'-fluoro corresponding nucleoside"
  modified_base 1,3,5,7,9,11,13,14,17,19,21,23,25: /mod_base = "2'-O-methyl corresponding nucleoside"
  modified_base 26: /mod_base = "3'-3'-linked nucleotide"
  modified_base 1: /mod_base = "5' end (chol-tEg) modification"
uauaugcccaagaaagugaaagacca

SEQ ID NO: 1058 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
  modified_base 1: /mod_base = "5' end (chol-tEg) modification"
uauaugcccaagaaagugaaagacca

SEQ ID NO: 1059 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 1: /mod_base = "5' end (chol-tEg) modification"
uauaugcccaagaaagugaaagacca

SEQ ID NO: 1060 - DNA, 26 bp, artificial sequence
  sense strand of an RNAi agent
  modified_base 2,4: /mod_base = "2'-hydroxy corresponding nucleoside"
  modified_base 6,8,10,12,13,16,18,20,22,24: /mod_base = "2'-deoxy-2'-fluoro corresponding nucleoside"
  modified_base 1,3,5,7,9,11,14,15,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
  modified_base 1: /mod_base = "5' end (chol-tEg) modification"
uauaugcccaagaaagugaaagacca

SEQ ID NO: 1061 - DNA, 26 bp, artificial sequence
  sense strand of an RNAi agent
  modified_base 2,4: /mod_base = "2'-hydroxy corresponding nucleoside"
  modified_base 6,8,10,12,13,16,18,20,22,24: /mod_base = "2'-deoxy-2'-fluoro corresponding nucleoside"
  modified_base 1,3,5,7,9,11,14,15,17,19,21,23,25: /mod_base = "2'-O-methyl corresponding nucleoside"
  modified_base 26: /mod_base = "3'-3'-linked nucleotide"
  modified_base 1: /mod_base = "5' end (chol-tEg) modification"
uauaugcccaagaaagugaaagacca

SEQ ID NO: 1062 - DNA, 26 bp, artificial sequence
  sense strand of an RNAi agent
  modified_base 2,4: /mod_base = "2'-hydroxy corresponding nucleoside"
  modified_base 6,8,10,13,14,16,18,20,22,24: /mod_base = "2'-deoxy-2'-fluoro corresponding nucleoside"
  modified_base 1,3,5,7,9,11,12,15,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
  modified_base 1: /mod_base = "5' end (chol-tEg) modification"
uauaugcccaagaaagugaaagacca

SEQ ID NO: 1063 - DNA, 26 bp, artificial sequence
  sense strand of an RNAi agent
  modified_base 2,4: /mod_base = "2'-hydroxy corresponding nucleoside"
  modified_base 6,8,10,13,14,16,18,20,22,24: /mod_base = "2'-deoxy-2'-fluoro corresponding nucleoside"
  modified_base 1,3,5,7,9,11,12,15,17,19,21,23,25: /mod_base = "2'-O-methyl corresponding nucleoside"
  modified_base 26: /mod_base = "3'-3'-linked nucleotide"
  modified_base 1: /mod_base = "5' end (chol-tEg) modification"
uauaugcccaagaaagugaaagacca

SEQ ID NO: 1064 - DNA, 26 bp, artificial sequence
  sense strand of an RNAi agent
  modified_base 2,4: /mod_base = "2'-hydroxy corresponding nucleoside"
  modified_base 6,8,10,11,14,16,18,20,22,24: /mod_base = "2'-deoxy-2'-fluoro corresponding nucleoside"
  modified_base 1,3,5,7,9,12,13,15,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
  modified_base 1: /mod_base = "5' end (chol-tEg) modification"
uauaugcccaagaaagugaaagacca

SEQ ID NO: 1065 - DNA, 26 bp, artificial sequence
  sense strand of an RNAi agent
  modified_base 2,4: /mod_base = "2'-hydroxy corresponding nucleoside"
  modified_base 6,8,10,11,14,16,18,20,22,24: /mod_base = "2'-deoxy-2'-fluoro corresponding nucleoside"
  modified_base 1,3,5,7,9,12,13,15,17,19,21,23,25: /mod_base = "2'-O-methyl corresponding nucleoside"
  modified_base 26: /mod_base = "3'-3'-linked nucleotide"
  modified_base 1: /mod_base = "5' end (chol-tEg) modification"
uauaugcccaagaaagugaaagacca

SEQ ID NO: 1066 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-SS-alk-Me) modification"
uauauguuuggagcccaagaaaguga

SEQ ID NO: 1067 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-SS-alk-Me) modification"
uauauuuuggagcccaagaaagugaa

SEQ ID NO: 1068 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-SS-alk-Me) modification"
uauauuuggagcccaagaaagugaaa

SEQ ID NO: 1069 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-SS-alk-Me) modification"
uauauuggagcccaagaaagugaaaa

SEQ ID NO: 1070 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-SS-alk-Me) modification"
uauauaagugcuuugagccucagcua

SEQ ID NO: 1071 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-SS-alk-Me) modification"
uauaugugcuuugagccucagcuuca

SEQ ID NO: 1072 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-SS-alk-Me) modification"
uauauggcuguggugaccgcaacaaa

SEQ ID NO: 1073 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-SS-alk-Me) modification"
uauaucuguggugaccgcaacaagca

SEQ ID NO: 1074 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c6-SS-alk-Me) modification"
uauauuguggugaccgcaacaagcca

SEQ ID NO: 1075 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 1: /mod_base = "5' end (NH2-c6) modification"
  modified_base 21: /mod_base = "3' end (c11-PEg3-Nag3) modification"
gcccaagaaagugaaagacca

SEQ ID NO: 1076 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 26: /mod_base = "3'-3'-linked nucleotide"
  modified_base 7: /mod_base = "5'-phosphorothioate corresponding nucleotide"
  modified_base 1: /mod_base = "5' end (chol-tEg) modification"
uauaugcccaagaaagugaaagacca

SEQ ID NO: 1077 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 1: /mod_base = "5' end (Me-alk-SS-c6) modification"
  modified_base 21: /mod_base = "3' end (c11-PEg3-Nag3) modification"
gcccaagaaagugaaagacca

SEQ ID NO: 1078 - DNA, 26 bp, artificial sequence
  sense strand of an RNAi agent
  modified_base 2,4: /mod_base = "2'-hydroxy corresponding nucleoside"
  modified_base 15: /mod_base = "2'-3' seco corresponding nucleotide"
  modified_base 6,8,10,12,14,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
  modified_base 1: /mod_base = "5' end (chol-tEg) modification"
uauaugcccaagaaagugaaagacca

SEQ ID NO: 1079 - DNA, 26 bp, artificial sequence
  sense strand of an RNAi agent
  modified_base 2,4: /mod_base = "2'-hydroxy corresponding nucleoside"
  modified_base 14: /mod_base = "2'-3' seco corresponding nucleotide"
  modified_base 6,8,10,12,16,18,20,22,24: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
  modified_base 1: /mod_base = "5' end (chol-tEg) modification"
uauaugcccaagaaagugaaagacca

SEQ ID NO: 1080 - DNA, 26 bp, artificial sequence
  sense strand of an RNAi agent
  modified_base 2,4: /mod_base = "2'-hydroxy corresponding nucleoside"
  modified_base 13: /mod_base = "2'-3' seco corresponding nucleotide"
  modified_base 6,8,10,12,14,16,18,20,22,24: /mod_base = "2'-deoxy-2'-fluoro corresponding nucleoside"
  modified_base 1,3,5,7,9,11,15,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
  modified_base 1: /mod_base = "5' end (chol-tEg) modification"
uauaugcccaagaaagugaaagacca

SEQ ID NO: 1081 - DNA, 26 bp, artificial sequence
  sense strand of an RNAi agent
  modified_base 2,4: /mod_base = "2'-hydroxy corresponding nucleoside"
  modified_base 12: /mod_base = "2'-3' seco corresponding nucleotide"
  modified_base 6,8,10,14,16,18,20,22,24: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
  modified_base 1: /mod_base = "5' end (chol-tEg) modification"
uauaugcccaagaaagugaaagacca

SEQ ID NO: 1082 - DNA, 21 bp, artificial sequence
  sense strand of an RNAi agent
  modified_base 1,3,5,7,9,11,13,15,17,19,21: /mod_base = "2'-deoxy-2'-fluoro corresponding nucleoside"
  modified_base 2,4,6,8,10,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-NH2) modification"
agcccaagaaagugaaagaca

SEQ ID NO: 1083 - DNA, 21 bp, artificial sequence
  sense strand of an RNAi agent
  modified_base 1,3,5,7,9,11,13,15,17,19,21: /mod_base = "2'-deoxy-2'-fluoro corresponding nucleoside"
  modified_base 2,4,6,8,10,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-SS-alk-Me) modification"
agcccaagaaagugaaagaca

SEQ ID NO: 1084 - DNA, 21 bp, artificial sequence
  sense strand of an RNAi agent
  modified_base 1,3,5,7,11,13,15,17,19,21: /mod_base = "2'-deoxy-2'-fluoro corresponding nucleoside"
  modified_base 2,4,6,8,9,10,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-NH2) modification"
cccaagaaagugaaagaccaa

SEQ ID NO: 1085 - DNA, 21 bp, artificial sequence
  sense strand of an RNAi agent
  modified_base 1,3,5,7,11,13,15,17,19,21: /mod_base = "2'-deoxy-2'-fluoro corresponding nucleoside"
  modified_base 2,4,6,8,9,10,12,14,16,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-SS-alk-Me) modification"
cccaagaaagugaaagaccaa

SEQ ID NO: 1086 - DNA, 26 bp, artificial sequence
  sense strand of an RNAi agent
  modified_base 1,2,3,4,5: /mod_base = "2'-hydroxy corresponding nucleoside"
  modified_base 6,8,10,12,15,16,18,20,22,24: /mod_base = "2'-deoxy-2'-fluoro corresponding nucleoside"
  modified_base 7,9,11,13,14,17,19,21,23,25: /mod_base = "2'-O-methyl corresponding nucleoside"
  modified_base 26: /mod_base = "3'-3'-linked nucleotide"
  modified_base 7: /mod_base = "5'-phosphorothioate corresponding nucleotide"
  modified_base 1: /mod_base = "5' end (chol-tEg) modification"
uauuagcccaagaaagugaaagacca

SEQ ID NO: 1087 - DNA, 26 bp, artificial sequence
  sense strand of an RNAi agent
  modified_base 5: /mod_base = "2'-hydroxy corresponding nucleoside"
  modified_base 1,3,6,8,10,12,15,16,18,20,22,24: /mod_base = "2'-deoxy-2'-fluoro corresponding nucleoside"
  modified_base 2,4,7,9,11,13,14,17,19,21,23,25: /mod_base = "2'-O-methyl corresponding nucleoside"
  modified_base 26: /mod_base = "3'-3'-linked nucleotide"
  modified_base 7: /mod_base = "5'-phosphorothioate corresponding nucleotide"
  modified_base 1: /mod_base = "5' end (chol-tEg) modification"
uauaagcccaagaaagugaaagacca

SEQ ID NO: 1088 - DNA, 26 bp, artificial sequence
  sense strand of an RNAi agent
  modified_base 5: /mod_base = "2'-hydroxy corresponding nucleoside"
  modified_base 6,8,10,12,15,16,18,20,22,24: /mod_base = "2'-deoxy-2'-fluoro corresponding nucleoside"
  modified_base 1,2,3,4,7,9,11,13,14,17,19,21,23,25: /mod_base = "2'-O-methyl corresponding nucleoside"
  modified_base 26: /mod_base = "3'-3'-linked nucleotide"
  modified_base 7: /mod_base = "5'-phosphorothioate corresponding nucleotide"
  modified_base 1: /mod_base = "5' end (chol-tEg) modification"
uauaagcccaagaaagugaaagacca

SEQ ID NO: 1089 - DNA, 26 bp, artificial sequence
  sense strand of an RNAi agent
  modified_base 1,2,3,4,5: /mod_base = "2'-hydroxy corresponding nucleoside"
  modified_base 6,8,10,12,15,16,18,20,22,24: /mod_base = "2'-deoxy-2'-fluoro corresponding nucleoside"
  modified_base 7,9,11,13,14,17,19,21,23,25: /mod_base = "2'-O-methyl corresponding nucleoside"
  modified_base 26: /mod_base = "3'-3'-linked nucleotide"
  modified_base 7: /mod_base = "5'-phosphorothioate corresponding nucleotide"
  modified_base 1: /mod_base = "5' end (chol-tEg) modification"
auauugcccaagaaagugaaagacca

SEQ ID NO: 1090 - DNA, 26 bp, artificial sequence
  sense strand of an RNAi agent
  modified_base 5: /mod_base = "2'-hydroxy corresponding nucleoside"
  modified_base 1,3,6,8,10,12,15,16,18,20,22,24: /mod_base = "2'-deoxy-2'-fluoro corresponding nucleoside"
  modified_base 2,4,7,9,11,13,14,17,19,21,23,25: /mod_base = "2'-O-methyl corresponding nucleoside"
  modified_base 26: /mod_base = "3'-3'-linked nucleotide"
  modified_base 7: /mod_base = "5'-phosphorothioate corresponding nucleotide"
  modified_base 1: /mod_base = "5' end (chol-tEg) modification"
auauugcccaagaaagugaaagacca

SEQ ID NO: 1091 - DNA, 26 bp, artificial sequence
  sense strand of an RNAi agent
  modified_base 5: /mod_base = "2'-hydroxy corresponding nucleoside"
  modified_base 6,8,10,12,15,16,18,20,22,24: /mod_base = "2'-deoxy-2'-fluoro corresponding nucleoside"
  modified_base 1,2,3,4,7,9,11,13,14,17,19,21,23,25: /mod_base = "2'-O-methyl corresponding nucleoside"
  modified_base 26: /mod_base = "3'-3'-linked nucleotide"
  modified_base 7: /mod_base = "5'-phosphorothioate corresponding nucleotide"
  modified_base 1: /mod_base = "5' end (chol-tEg) modification"
auauugcccaagaaagugaaagacca

SEQ ID NO: 1092 - DNA, 22 bp, artificial sequence
  sense strand of an RNAi agent
  modified_base 21: /mod_base = "2'-hydroxy corresponding nucleoside"
  modified_base 1,3,5,7,9,11,13,15,17,19: /mod_base = "2'-deoxy-2'-fluoro corresponding nucleoside"
  modified_base 2,4,6,8,10,12,14,16,18,20,22: /mod_base = "2'-O-methyl corresponding nucleoside"
  modified_base 22: /mod_base = "3' end (tEg-chol) modification"
ccaagaaagugaaagaccauau

SEQ ID NO: 1093 - DNA, 21 bp, artificial sequence
  sense strand of an RNAi agent
  modified_base 3,5,9,10,11,15,19,21: /mod_base = "2'-deoxy-2'-fluoro corresponding nucleoside"
  modified_base 1,2,4,6,7,8,12,13,14,16,17,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-NH2) modification"
gcccaagaaagugaaagacca

SEQ ID NO: 1094 - DNA, 21 bp, artificial sequence
  sense strand of an RNAi agent
  modified_base 3,5,9,10,11,15,19,21: /mod_base = "2'-deoxy-2'-fluoro corresponding nucleoside"
  modified_base 1,2,4,6,7,8,12,13,14,16,17,18,20: /mod_base = "2'-O-methyl corresponding nucleoside"
  modified_base 2,3: /mod_base = "5'-phosphorothioate corresponding nucleotide"
  modified_base 21: /mod_base = "3' end (c6-NH2) modification"
gcccaagaaagugaaagacca

SEQ ID NO: 1095 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1096 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (DBcO-tEg) modification"
  modified_base 26: /mod_base = "3' end (c11-PEg3-Nag3) modification"
uauaugcccaagaaagugaaagacca

SEQ ID NO: 1097 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c11-PEg3-Nag3) modification"
uauaugugcuuugagccucagcuuca

SEQ ID NO: 1098 - DNA, 26 bp, artificial sequence
  sense strand of an RNAi agent
  modified_base 2,4: /mod_base = "2'-hydroxy corresponding nucleoside"
  modified_base 8,10,12,14,16,18,20,22,24,26: /mod_base = "2'-deoxy-2'-fluoro corresponding nucleoside"
  modified_base 1,3,5,6,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c11-PEg3-Nag3) modification"
uauaugugcuuugagccucagcuuca

SEQ ID NO: 1099 - DNA, 26 bp, artificial sequence
  sense strand of an RNAi agent
  modified_base 2,4: /mod_base = "2'-hydroxy corresponding nucleoside"
  modified_base 6,10,12,14,16,18,20,22,24,26: /mod_base = "2'-deoxy-2'-fluoro corresponding nucleoside"
  modified_base 1,3,5,7,8,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c11-PEg3-Nag3) modification"
uauaugugcuuugagccucagcuuca

SEQ ID NO: 1100 - DNA, 26 bp, artificial sequence
  sense strand of an RNAi agent
  modified_base 2,4: /mod_base = "2'-hydroxy corresponding nucleoside"
  modified_base 10,12,14,16,18,20,22,24,26: /mod_base = "2'-deoxy-2'-fluoro corresponding nucleoside"
  modified_base 1,3,5,6,7,8,9,11,13,15,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c11-PEg3-Nag3) modification"
uauaugugcuuugagccucagcuuca

SEQ ID NO: 1101 - DNA, 26 bp, artificial sequence
  sense strand of an RNAi agent
  modified_base 2,4: /mod_base = "2'-hydroxy corresponding nucleoside"
  modified_base 10,12,14,16,18,20,22,24,26: /mod_base = "2'-deoxy-2'-fluoro corresponding nucleoside"
  modified_base 1,3,5,6,7,8,9,11,13,15,17,19,21,23,25: /mod_base = "2'-O-methyl corresponding nucleoside"
  modified_base 6,7: /mod_base = "5'-phosphorothioate corresponding nucleotide"
  modified_base 1: /mod_base = "5' end (DBcO-tEg) modification"
  modified_base 26: /mod_base = "3' end (c11-PEg3-Nag3) modification"
uauaugugcuuugagccucagcuuca

SEQ ID NO: 1102 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
uggagcccaagaaaguga

SEQ ID NO: 1103 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
ggagcccaagaaagugaa

SEQ ID NO: 1104 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
gagcccaagaaagugaaa

SEQ ID NO: 1105 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
agcccaagaaagugaaaa

SEQ ID NO: 1106 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
gcccaagaaagugaaaga

SEQ ID NO: 1107 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
cccaagaaagugaaagaa

SEQ ID NO: 1108 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
ccaagaaagugaaagaca

SEQ ID NO: 1109 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
caagaaagugaaagacca

SEQ ID NO: 1110 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
aagaaagugaaagaccaa

SEQ ID NO: 1111 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
ugcuuugagccucagcua

SEQ ID NO: 1112 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
cuuugagccucagcuuca

SEQ ID NO: 1113 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
uugagccucagcuucuca

SEQ ID NO: 1114 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
uguggugaccgcaacaaa

SEQ ID NO: 1115 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
guggugaccgcaacaaga

SEQ ID NO: 1116 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
uggugaccgcaacaagca

SEQ ID NO: 1117 - DNA, 18 bp, artificial sequence
  sense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18: /mod_base = "3'-3'-linked nucleotide"
  modified_base 2,3: /mod_base = "5'-phosphorothioate corresponding nucleotide"
ggugaccgcaacaagcca

SEQ ID NO: 1118 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
ggagcccaagaaaguga

SEQ ID NO: 1119 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
gagcccaagaaagugaa

SEQ ID NO: 1120 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
agcccaagaaagugaaa

SEQ ID NO: 1121 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
gcccaagaaagugaaaa

SEQ ID NO: 1122 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
cccaagaaagugaaaga

SEQ ID NO: 1123 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
ccaagaaagugaaagaa

SEQ ID NO: 1124 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
caagaaagugaaagaca

SEQ ID NO: 1125 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
aagaaagugaaagacca

SEQ ID NO: 1126 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
agaaagugaaagaccaa

SEQ ID NO: 1127 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
gcuuugagccucagcua

SEQ ID NO: 1128 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
uuugagccucagcuuca

SEQ ID NO: 1129 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
ugagccucagcuucuca

SEQ ID NO: 1130 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
guggugaccgcaacaaa

SEQ ID NO: 1131 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
uggugaccgcaacaaga

SEQ ID NO: 1132 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
ggugaccgcaacaagca

SEQ ID NO: 1133 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14,16: /mod_base = "2'-O-methyl corresponding nucleoside"
  modified_base 17: /mod_base = "3'-3'-linked nucleotide"
  modified_base 2,3: /mod_base = "5'-phosphorothioate corresponding nucleotide"
gugaccgcaacaagcca

SEQ ID NO: 1134 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (NH2-c6) modification"
  modified_base 26: /mod_base = "3' end (c11-PEg3-Nag3) modification"
uauaugcccaagaaagugaaagacca

SEQ ID NO: 1135 - DNA, 26 bp, artificial sequence
  sense strand of an RNAi agent
  modified_base 2,4: /mod_base = "2'-hydroxy corresponding nucleoside"
  modified_base 10,12,14,16,18,20,22,24,26: /mod_base = "2'-deoxy-2'-fluoro corresponding nucleoside"
  modified_base 1,3,5,6,7,8,9,11,13,15,17,19,21,23,25: /mod_base = "2'-O-methyl corresponding nucleoside"
  modified_base 6,7: /mod_base = "5'-phosphorothioate corresponding nucleotide"
  modified_base 1: /mod_base = "5' end (NH2-c6) modification"
  modified_base 26: /mod_base = "3' end (c11-PEg3-Nag3) modification"
uauaugugcuuugagccucagcuuca

SEQ ID NO: 1136 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (alk-c6) modification"
  modified_base 26: /mod_base = "3' end (c11-PEg3-Nag3) modification"
uauaugcccaagaaagugaaagacca

SEQ ID NO: 1137 - DNA, 26 bp, artificial sequence
  sense strand of an RNAi agent
  modified_base 2,4: /mod_base = "2'-hydroxy corresponding nucleoside"
  modified_base 10,12,14,16,18,20,22,24,26: /mod_base = "2'-deoxy-2'-fluoro corresponding nucleoside"
  modified_base 1,3,5,6,7,8,9,11,13,15,17,19,21,23,25: /mod_base = "2'-O-methyl corresponding nucleoside"
  modified_base 6,7: /mod_base = "5'-phosphorothioate corresponding nucleotide"
  modified_base 1: /mod_base = "5' end (alk-c6) modification"
  modified_base 26: /mod_base = "3' end (c11-PEg3-Nag3) modification"
uauaugugcuuugagccucagcuuca

SEQ ID NO: 1138 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 1: /mod_base = "5' end (Spermine) modification"
  modified_base 26: /mod_base = "3' end (c11-PEg3-Nag3) modification"
uauaugugcuuugagccucagcuuca

SEQ ID NO: 1139 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 1: /mod_base = "5' end (Spermine)2 modification"
  modified_base 26: /mod_base = "3' end (c11-PEg3-Nag3) modification"
uauaugugcuuugagccucagcuuca

SEQ ID NO: 1140 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 6,7: /mod_base = "5'-phosphorothioate corresponding nucleotide"
  modified_base 1: /mod_base = "5' end (Spermine)3 modification"
  modified_base 26: /mod_base = "3' end (c11-PEg3-Nag3) modification"
uauaugugcuuugagccucagcuuca

SEQ ID NO: 1141 - DNA, 26 bp, artificial sequence
  sense strand of an RNAi agent
  modified_base 2,4: /mod_base = "2'-hydroxy corresponding nucleoside"
  modified_base 6,8,10,11,14,16,18,20,22,24: /mod_base = "2'-deoxy-2'-fluoro corresponding nucleoside"
  modified_base 1,3,5,7,9,12,13,15,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
uauaugcccaagaaagugaaagacca

SEQ ID NO: 1142 - DNA, 26 bp, artificial sequence
  sense strand of an RNAi agent
  modified_base 2,4: /mod_base = "2'-hydroxy corresponding nucleoside"
  modified_base 8,10,14,15,16,20,24,26: /mod_base = "2'-deoxy-2'-fluoro corresponding nucleoside"
  modified_base 1,3,5,6,7,9,11,12,13,17,18,19,21,22,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-NH2) modification"
uauaugcccaagaaagugaaagacca

SEQ ID NO: 1143 - DNA, 26 bp, artificial sequence
  sense strand of an RNAi agent
  modified_base 2,4: /mod_base = "2'-hydroxy corresponding nucleoside"
  modified_base 8,10,14,15,16,20,24,26: /mod_base = "2'-deoxy-2'-fluoro corresponding nucleoside"
  modified_base 1,3,5,6,7,9,11,12,13,17,18,19,21,22,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-SS-alk-Me) modification"
uauaugcccaagaaagugaaagacca

SEQ ID NO: 1144 - DNA, 26 bp, artificial sequence
  sense strand of an RNAi agent
  modified_base 2,4: /mod_base = "2'-hydroxy corresponding nucleoside"
  modified_base 8,10,14,15,16,20,24,26: /mod_base = "2'-deoxy-2'-fluoro corresponding nucleoside"
  modified_base 1,3,5,6,7,9,11,12,13,17,18,19,21,22,23,25: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1145 - DNA, 26 bp, artificial sequence
  sense strand of an RNAi agent
  modified_base 2,4: /mod_base = "2'-hydroxy corresponding nucleoside"
  modified_base 15,16: /mod_base = "2'-deoxy-2'-fluoro corresponding nucleoside"
  modified_base 1,3,5,6,7,8,9,10,11,12,13,14,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1146 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1147 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (Stearyl) modification"
  modified_base 26: /mod_base = "3' end (c11-PEg3-Nag3) modification"
uauaugcccaagaaagugaaagacca

SEQ ID NO: 1148 - DNA, 25 bp, artificial sequence
  sense strand of an RNAi agent
  modified_base 1,3: /mod_base = "2'-hydroxy corresponding nucleoside"
  modified_base 5,7,9,10,13,15,17,19,21,23: /mod_base = "2'-deoxy-2'-fluoro corresponding nucleoside"
  modified_base 2,4,6,8,11,12,14,16,18,20,22,24: /mod_base = "2'-O-methyl corresponding nucleoside"
  modified_base 25: /mod_base = "3'-3'-linked nucleotide"
  modified_base 5: /mod_base = "5'-phosphorothioate corresponding nucleotide"
  modified_base 1: /mod_base = "5' end (chol-tEg) modification"
auaugcccaagaaagugaaagacca

SEQ ID NO: 1149 - DNA, 24 bp, artificial sequence
  sense strand of an RNAi agent
  modified_base 2: /mod_base = "2'-hydroxy corresponding nucleoside"
  modified_base 4,6,8,9,12,14,16,18,20,22: /mod_base = "2'-deoxy-2'-fluoro corresponding nucleoside"
  modified_base 1,3,5,7,10,11,13,15,17,19,21,23: /mod_base = "2'-O-methyl corresponding nucleoside"
  modified_base 24: /mod_base = "3'-3'-linked nucleotide"
  modified_base 4: /mod_base = "5'-phosphorothioate corresponding nucleotide"
  modified_base 1: /mod_base = "5' end (chol-tEg) modification"
uaugcccaagaaagugaaagacca

SEQ ID NO: 1150 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (BcN) modification"
  modified_base 26: /mod_base = "3' end (c11-PEg3-Nag3) modification"
uauaugcccaagaaagugaaagacca

SEQ ID NO: 1151 - DNA, 26 bp, artificial sequence
  sense strand of an RNAi agent
  modified_base 3,6,8,10,12,14,15,16,18,20,22,24,26: /mod_base = "2'-deoxy-2'-fluoro corresponding nucleoside"
  modified_base 1,2,4,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1152 - DNA, 26 bp, artificial sequence
  sense strand of an RNAi agent
  modified_base 3,6,8,10,12,14,15,16,18,20,22,24,26: /mod_base = "2'-deoxy-2'-fluoro corresponding nucleoside"
  modified_base 1,2,4,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (Me-alk-SS-c6) modification"
  modified_base 26: /mod_base = "3' end (c11-PEg3-Nag3) modification"
uauaugcccaagaaagugaaagacca

SEQ ID NO: 1153 - DNA, 26 bp, artificial sequence
  sense strand of an RNAi agent
  modified_base 3,6,8,10,12,14,15,16,18,20,22,24,26: /mod_base = "2'-deoxy-2'-fluoro corresponding nucleoside"
  modified_base 1,2,4,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (NH2-c6) modification"
  modified_base 26: /mod_base = "3' end (c11-PEg3-Nag3) modification"
uauaugcccaagaaagugaaagacca

SEQ ID NO: 1154 - DNA, 23 bp, artificial sequence
  sense strand of an RNAi agent
  modified_base 1: /mod_base = "2'-hydroxy corresponding nucleoside"
  modified_base 3,5,7,9,11,12,13,15,17,19,21,23: /mod_base = "2'-deoxy-2'-fluoro corresponding nucleoside"
  modified_base 2,4,6,8,10,14,16,18,20,22: /mod_base = "2'-O-methyl corresponding nucleoside"
  modified_base 4,5: /mod_base = "5'-phosphorothioate corresponding nucleotide"
  modified_base 23: /mod_base = "3' end (c11-PEg3-Nag3) modification"
augcccaagaaagugaaagacca

SEQ ID NO: 1155 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (Norbornene-c6) modification"
  modified_base 26: /mod_base = "3' end (c11-PEg3-Nag3) modification"
uauaugcccaagaaagugaaagacca

SEQ ID NO: 1156 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (alk-Bc9-c6) modification"
  modified_base 26: /mod_base = "3' end (c11-PEg3-Nag3) modification"
uauaugcccaagaaagugaaagacca

SEQ ID NO: 1157 - DNA, 26 bp, artificial sequence
  sense strand of an RNAi agent
  modified_base 2,4: /mod_base = "2'-hydroxy corresponding nucleoside"
  modified_base 8,10,14,15,16,20,24,26: /mod_base = "2'-deoxy-2'-fluoro corresponding nucleoside"
  modified_base 1,3,5,6,7,9,11,12,13,17,18,19,21,22,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-Nag3) modification"
uauaugcccaagaaagugaaagacca

SEQ ID NO: 1158 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-Ser) modification"
uauaugcccaagaaagugaaagacca

SEQ ID NO: 1159 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-Ser)3 modification"
uauaugcccaagaaagugaaagacca

SEQ ID NO: 1160 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Norbornene-Ser) modification"
uauaugcccaagaaagugaaagacca

SEQ ID NO: 1161 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Norbornene-Ser)3 modification"
uauaugcccaagaaagugaaagacca

SEQ ID NO: 1162 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6) modification"
uauaugcccaagaaagugaaagacca

SEQ ID NO: 1163 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Norbornene-c6) modification"
uauaugcccaagaaagugaaagacca

SEQ ID NO: 1164 - DNA, 17 bp, artificial sequence
  sense strand of an RNAi agent
  modified_base 1,3,5,7,9,11,13,15,17: /mod_base = "2'-deoxy-2'-fluoro corresponding nucleoside"
  modified_base 2,4,6,8,10,12,14,16: /mod_base = "2'-O-methyl corresponding nucleoside"
  modified_base 2,3: /mod_base = "5'-phosphorothioate corresponding nucleotide"
  modified_base 17: /mod_base = "3' end (c11-PEg3-Nag3) modification"
ggagcccaagaaaguga

SEQ ID NO: 1165 - DNA, 17 bp, artificial sequence
  sense strand of an RNAi agent
  modified_base 1,3,5,7,9,11,13,15,17: /mod_base = "2'-deoxy-2'-fluoro corresponding nucleoside"
  modified_base 2,4,6,8,10,12,14,16: /mod_base = "2'-O-methyl corresponding nucleoside"
  modified_base 2,3: /mod_base = "5'-phosphorothioate corresponding nucleotide"
  modified_base 17: /mod_base = "3' end (c11-PEg3-Nag3) modification"
cccaagaaagugaaaga

SEQ ID NO: 1166 - DNA, 17 bp, artificial sequence
  sense strand of an RNAi agent
  modified_base 1,3,5,7,9,11,13,15,17: /mod_base = "2'-deoxy-2'-fluoro corresponding nucleoside"
  modified_base 2,4,6,8,10,12,14,16: /mod_base = "2'-O-methyl corresponding nucleoside"
  modified_base 2,3: /mod_base = "5'-phosphorothioate corresponding nucleotide"
  modified_base 17: /mod_base = "3' end (c11-PEg3-Nag3) modification"
aagaaagugaaagacca

SEQ ID NO: 1167 - DNA, 17 bp, artificial sequence
  sense strand of an RNAi agent
  modified_base 1,3,5,7,9,11,13,15,17: /mod_base = "2'-deoxy-2'-fluoro corresponding nucleoside"
  modified_base 2,4,6,8,10,12,14,16: /mod_base = "2'-O-methyl corresponding nucleoside"
  modified_base 2,3: /mod_base = "5'-phosphorothioate corresponding nucleotide"
  modified_base 17: /mod_base = "3' end (c11-PEg3-Nag3) modification"
agaaagugaaagaccaa

SEQ ID NO: 1168 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (Spermine) modification"
  modified_base 26: /mod_base = "3' end (c11-PEg3-Nag3) modification"
uauaugcccaagaaagugaaagacca

SEQ ID NO: 1169 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (Spermine)2 modification"
  modified_base 26: /mod_base = "3' end (c11-PEg3-Nag3) modification"
uauaugcccaagaaagugaaagacca

SEQ ID NO: 1170 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (Spermine)3 modification"
  modified_base 26: /mod_base = "3' end (c11-PEg3-Nag3) modification"
uauaugcccaagaaagugaaagacca

SEQ ID NO: 1171 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (NH2-c6) modification"
  modified_base 26: /mod_base = "3' end (c6-NH2) modification"
uauaugcccaagaaagugaaagacca

SEQ ID NO: 1172 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23: /mod_base = "2'-O-methyl corresponding nucleoside"
  modified_base 25, 26: /mod_base = "2'-MOE nucleotide"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1173 - DNA, 26 bp, artificial sequence
  sense strand of an RNAi agent
  modified_base 2,4: /mod_base = "2'-hydroxy corresponding nucleoside"
  modified_base 5: /mod_base = "2'-3' seco corresponding nucleotide"
  modified_base 6,8,10,12,14,15,16,18,20,22,24,26: /mod_base = "2'-deoxy-2'-fluoro corresponding nucleoside"
  modified_base 1,3,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1174 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 1: /mod_base = "5' end (Spermine) modification"
  modified_base 21: /mod_base = "3' end (c11-PEg3-Nag3) modification"
gcccaagaaagugaaagacca

SEQ ID NO: 1175 - DNA, 21 bp, artificial sequence
  sense strand of an RNAi agent
  modified_base 1,3,5,7,9,10,11,13,15,17,19,21: /mod_base = "2'-deoxy-2'-fluoro corresponding nucleoside"
  modified_base 2,4,6,8,12,14,16,18,20: /mod_base = "2'-O-methyl corresponding nucleoside"
  modified_base 2,3: /mod_base = "5'-phosphorothioate corresponding nucleotide"
  modified_base 1: /mod_base = "5' end (Spermine)3 modification"
  modified_base 21: /mod_base = "3' end (c11-PEg3-Nag3) modification"
gcccaagaaagugaaagacca

SEQ ID NO: 1176 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end modification"
  modified_base 26: /mod_base = "3' end (c11-PEg3-Nag3) modification"
uauaugcccaagaaagugaaagacca

SEQ ID NO: 1177 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (alk-PEg4-c6) modification"
  modified_base 26: /mod_base = "3' end (c11-PEg3-Nag3) modification"
uauaugcccaagaaagugaaagacca

SEQ ID NO: 1178 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-NH2) modification"
uauaugcccaagaaagugaaagacca

SEQ ID NO: 1179 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-PEg4-Nag3) modification"
uauaugcccaagaaagugaaagacca

SEQ ID NO: 1180 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (c6-PEg4-Nag3) modification"
  modified_base 26: /mod_base = "3' end (c6-NH2) modification"
uauaugcccaagaaagugaaagacca

SEQ ID NO: 1181 - DNA, 26 bp, artificial sequence
  sense strand of an RNAi agent
  modified_base 2,4,25: /mod_base = "2'-hydroxy corresponding nucleoside"
  modified_base 6,8,10,12,14,15,16,18,20,22: /mod_base = "2'-deoxy-2'-fluoro corresponding nucleoside"
  modified_base 1,3,5,7,9,11,13,17,19,21,23,24,26: /mod_base = "2'-O-methyl corresponding nucleoside"
  modified_base 7,8: /mod_base = "5'-phosphorothioate corresponding nucleotide"
  modified_base 26: /mod_base = "3' end (c6-NH2) modification"
uauaugcccaagaaagugaaagauau

SEQ ID NO: 1182 - DNA, 26 bp, artificial sequence
  sense strand of an RNAi agent
  modified_base 2,4,25: /mod_base = "2'-hydroxy corresponding nucleoside"
  modified_base 6,8,10,12,14,15,16,18,20,22: /mod_base = "2'-deoxy-2'-fluoro corresponding nucleoside"
  modified_base 1,3,5,7,9,11,13,17,19,21,23,24,26: /mod_base = "2'-O-methyl corresponding nucleoside"
  modified_base 7,8: /mod_base = "5'-phosphorothioate corresponding nucleotide"
  modified_base 26: /mod_base = "3' end (c6-PEg4-Nag3) modification"
uauaugcccaagaaagugaaagauau

SEQ ID NO: 1183 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (tetz-c6) modification"
  modified_base 26: /mod_base = "3' end (c11-PEg3-Nag3) modification"
uauaugcccaagaaagugaaagacca

SEQ ID NO: 1184 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (alk-PEg5-c6) modification"
  modified_base 26: /mod_base = "3' end (c11-PEg3-Nag3) modification"
uauaugcccaagaaagugaaagacca

SEQ ID NO: 1185 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (alk-NHcO-c6) modification"
  modified_base 26: /mod_base = "3' end (c11-PEg3-Nag3) modification"
uauaugcccaagaaagugaaagacca

SEQ ID NO: 1186 - DNA, 26 bp, artificial sequence
  sense strand of an RNAi agent
  modified_base 3,6,8,10,12,14,15,16,18,20,22,24,26: /mod_base = "2'-deoxy-2'-fluoro corresponding nucleoside"
  modified_base 1,2,4,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 1: /mod_base = "5' end (alk-NHcO-SS-c6) modification"
  modified_base 26: /mod_base = "3' end (c11-PEg3-Nag3) modification"
uauaugcccaagaaagugaaagacca

SEQ ID NO: 1187 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 6,7: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1188 - DNA, 26 bp, artificial sequence
  sense strand of an RNAi agent
  modified_base 2,4: /mod_base = "2'-hydroxy corresponding nucleoside"
  modified_base 6,8,10,12,14,16,18,20,22,24,26: /mod_base = "2'-deoxy-2'-fluoro corresponding nucleoside"
  modified_base 1,3,5,7,9,11,13,15,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugugcuuugagccucagcuuca

SEQ ID NO: 1189 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6)(NH2-Ser) modification"
uauaugcccaagaaagugaaagacca

SEQ ID NO: 1190 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6)(NH2-Ser)2 modification"
uauaugcccaagaaagugaaagacca

SEQ ID NO: 1191 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6)(NH2-Ser)3 modification"
uauaugcccaagaaagugaaagacca

SEQ ID NO: 1192 - DNA, 26 bp, artificial sequence
  sense strand of an RNAi agent
  modified_base 2,4: /mod_base = "2'-hydroxy corresponding nucleoside"
  modified_base 16,18: /mod_base = "2'-deoxy-2'-fluoro corresponding nucleoside"
  modified_base 1,3,5,6,7,8,9,10,11,12,13,14,15,17,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1193 - DNA, 26 bp, artificial sequence
  sense strand of an RNAi agent
  modified_base 2,4: /mod_base = "2'-hydroxy corresponding nucleoside"
  modified_base 16: /mod_base = "2'-deoxy-2'-fluoro corresponding nucleoside"
  modified_base 1,3,5,6,7,8,9,10,11,12,13,14,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1194 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-c12-Nag3) modification"
uauaugcccaagaaagugaaagacca

SEQ ID NO: 1195 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c11-palm-Nag3) modification"
uauaugcccaagaaagugaaagacca

SEQ ID NO: 1196 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-SS-c6)(c11-palm-Nag3) modification"
uauaugcccaagaaagugaaagacca

SEQ ID NO: 1197 - DNA, 26 bp, artificial sequence
  sense strand of an RNAi agent
  modified_base 2,4,25: /mod_base = "2'-hydroxy corresponding nucleoside"
  modified_base 6,8,10,12,14,15,16,18,20,22: /mod_base = "2'-deoxy-2'-fluoro corresponding nucleoside"
  modified_base 1,3,5,7,9,11,13,17,19,21,23,24,26: /mod_base = "2'-O-methyl corresponding nucleoside"
  modified_base 7,8: /mod_base = "5'-phosphorothioate corresponding nucleotide"
  modified_base 26: /mod_base = "3' end (c11-palm-Nag3) modification"
uauaugcccaagaaagugaaagauau

SEQ ID NO: 1198 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6)(alk-c6-Ser) modification"
uauaugcccaagaaagugaaagacca

SEQ ID NO: 1199 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6)(alk-c6-Ser)2 modification"
uauaugcccaagaaagugaaagacca

SEQ ID NO: 1200 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6)(alk-c6-Ser)3 modification"
uauaugcccaagaaagugaaagacca

SEQ ID NO: 1201 - DNA, 26 bp, artificial sequence
  sense strand of an RNAi agent
  modified_base 3,14,16: /mod_base = "2'-deoxy-2'-fluoro corresponding nucleoside"
  modified_base 1,2,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1202 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1203 - DNA, 26 bp, artificial sequence
  sense strand of an RNAi agent
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1204 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 26: /mod_base = "3' end (c11-PEg3-Nag3) modification"
uaugcccaagaaagugaaagaccuau

SEQ ID NO: 1205 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-c6-Nag3) modification"
uauaugcccaagaaagugaaagacca

SEQ ID NO: 1206 - DNA, 26 bp, artificial sequence
  sense strand of an RNAi agent
  modified_base 2,4: /mod_base = "2'-hydroxy corresponding nucleoside"
  modified_base 6,8,10,12,14,15,16,18,20,22,24,26: /mod_base = "2'-deoxy-2'-fluoro corresponding nucleoside"
  modified_base 1,3,5,7,9,11,13,17,19,21,23,25: /mod_base = "2'-O-methyl corresponding nucleoside"
  modified_base 7,8: /mod_base = "5'-phosphorothioate corresponding nucleotide"
  modified_base 26: /mod_base = "3' end (c6-SS-c6)(c11-PEg3-Nag3) modification"
uauaugcccaagaaagugaaagacca

SEQ ID NO: 1207 - DNA, 26 bp, artificial sequence
  sense strand of an RNAi agent
  modified_base 2,4: /mod_base = "2'-hydroxy corresponding nucleoside"
  modified_base 15,16: /mod_base = "2'-deoxy-2'-fluoro corresponding nucleoside"
  modified_base 1,3,5,6,7,8,9,10,11,12,13,14,17,18,19,20,21,22,23,24: /mod_base = "2'-O-methyl corresponding nucleoside"
  modified_base 25,26: /mod_base = "2'-MOE nucleotide"
  modified_base 7,8: /mod_base = "5'-phosphorothioate corresponding nucleotide"
  modified_base 26: /mod_base = "3' end (c11-PEg3-Nag3) modification"
uauaugcccaagaaagugaaagacca

SEQ ID NO: 1208 - DNA, 26 bp, artificial sequence
  sense strand of an RNAi agent
  modified_base 2,4: /mod_base = "2'-hydroxy corresponding nucleoside"
  modified_base 15,16: /mod_base = "2'-deoxy-2'-fluoro corresponding nucleoside"
  modified_base 1,3,5,6,7,8,9,10,11,12,13,14,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (c6-NH2) modification"
uauaugcccaagaaagugaaagacca

SEQ ID NO: 1209 - DNA, 26 bp, artificial sequence
  sense strand of an RNAi agent
  modified_base 2,4: /mod_base = "2'-hydroxy corresponding nucleoside"
  modified_base 15,16: /mod_base = "2'-deoxy-2'-fluoro corresponding nucleoside"
  modified_base 1,3,5,6,7,8,9,10,11,12,13,14,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (c6-Nag3) modification"
uauaugcccaagaaagugaaagacca

SEQ ID NO: 1210 - DNA, 26 bp, artificial sequence
  sense strand of an RNAi agent
  modified_base 2,4: /mod_base = "2'-hydroxy corresponding nucleoside"
  modified_base 15,16: /mod_base = "2'-deoxy-2'-fluoro corresponding nucleoside"
  modified_base 1,3,5,6,7,8,9,10,11,12,13,14,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (NH2-c7) modification"
uauaugcccaagaaagugaaagacca

SEQ ID NO: 1211 - DNA, 26 bp, artificial sequence
  sense strand of an RNAi agent
  modified_base 2,4: /mod_base = "2'-hydroxy corresponding nucleoside"
  modified_base 15,16: /mod_base = "2'-deoxy-2'-fluoro corresponding nucleoside"
  modified_base 1,3,5,6,7,8,9,10,11,12,13,14,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1212 - DNA, 17 bp, artificial sequence
  sense strand of an RNAi agent
  modified_base 5,7: /mod_base = "2'-deoxy-2'-fluoro corresponding nucleoside"
  modified_base 1,2,3,4,6,8,9,10,11,12,13,14,15,16,17: /mod_base = "2'-O-methyl corresponding nucleoside"
  modified_base 2,3: /mod_base = "5'-phosphorothioate corresponding nucleotide"
  modified_base 17: /mod_base = "3' end (c11-PEg3-Nag3) modification"
cccaagaaagugaaaga

SEQ ID NO: 1213 - DNA, 17 bp, artificial sequence
  sense strand of an RNAi agent
  modified_base 6,7: /mod_base = "2'-deoxy-2'-fluoro corresponding nucleoside"
  modified_base 1,2,3,4,5,8,9,10,11,12,13,14,15,16,17: /mod_base = "2'-O-methyl corresponding nucleoside"
  modified_base 2,3: /mod_base = "5'-phosphorothioate corresponding nucleotide"
  modified_base 17: /mod_base = "3' end (c11-PEg3-Nag3) modification"
cccaagaaagugaaaga

SEQ ID NO: 1214 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14: /mod_base = "2'-O-methyl corresponding nucleoside"
  modified_base 16,17: /mod_base = "2'-MOE nucleotide"
  modified_base 2,3: /mod_base = "5'-phosphorothioate corresponding nucleotide"
  modified_base 17: /mod_base = "3' end (c11-PEg3-Nag3) modification"
cccaagaaagugaaaga

SEQ ID NO: 1215 - DNA, 17 bp, artificial sequence
  sense strand of an RNAi agent
  modified_base 3,5,7,9,11,13,15: /mod_base = "2'-deoxy-2'-fluoro corresponding nucleoside"
  modified_base 4,6,8,10,12,14: /mod_base = "2'-O-methyl corresponding nucleoside"
  modified_base 1,2,16,17: /mod_base = "2'-MOE nucleotide"
  modified_base 2,3: /mod_base = "5'-phosphorothioate corresponding nucleotide"
  modified_base 17: /mod_base = "3' end (c11-PEg3-Nag3) modification"
cccaagaaagugaaaga

SEQ ID NO: 1216 - DNA, 17 bp, artificial sequence
  sense strand of an RNAi agent
  modified_base 3,5,7,9,11,13,15,17: /mod_base = "2'-deoxy-2'-fluoro corresponding nucleoside"
  modified_base 4,6,8,10,12,14,16: /mod_base = "2'-O-methyl corresponding nucleoside"
  modified_base 1,2: /mod_base = "2'-MOE nucleotide"
  modified_base 2,3: /mod_base = "5'-phosphorothioate corresponding nucleotide"
  modified_base 17: /mod_base = "3' end (c11-PEg3-Nag3) modification"
cccaagaaagugaaaga

SEQ ID NO: 1217 - DNA, 17 bp, artificial sequence
  sense strand of an RNAi agent
  modified_base 5,7: /mod_base = "2'-deoxy-2'-fluoro corresponding nucleoside"
  modified_base 1,2,3,4,6,8,9,10,11,12,13,14,15,16,17: /mod_base = "2'-O-methyl corresponding nucleoside"
  modified_base 2,3: /mod_base = "5'-phosphorothioate corresponding nucleotide"
  modified_base 17: /mod_base = "3' end (c11-PEg3-Nag3) modification"
aagaaagugaaagacca

SEQ ID NO: 1218 - DNA, 17 bp, artificial sequence
  sense strand of an RNAi agent
  modified_base 6,7: /mod_base = "2'-deoxy-2'-fluoro corresponding nucleoside"
  modified_base 1,2,3,4,5,8,9,10,11,12,13,14,15,16,17: /mod_base = "2'-O-methyl corresponding nucleoside"
  modified_base 2,3: /mod_base = "5'-phosphorothioate corresponding nucleotide"
  modified_base 17: /mod_base = "3' end (c11-PEg3-Nag3) modification"
aagaaagugaaagacca

SEQ ID NO: 1219 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14: /mod_base = "2'-O-methyl corresponding nucleoside"
  modified_base 16,17: /mod_base = "2'-MOE nucleotide"
  modified_base 2,3: /mod_base = "5'-phosphorothioate corresponding nucleotide"
  modified_base 17: /mod_base = "3' end (c11-PEg3-Nag3) modification"
aagaaagugaaagacca

SEQ ID NO: 1220 - DNA, 17 bp, artificial sequence
  sense strand of an RNAi agent
  modified_base 3,5,7,9,11,13,15: /mod_base = "2'-deoxy-2'-fluoro corresponding nucleoside"
  modified_base 4,6,8,10,12,14: /mod_base = "2'-O-methyl corresponding nucleoside"
  modified_base 1,2,16,17: /mod_base = "2'-MOE nucleotide"
  modified_base 2,3: /mod_base = "5'-phosphorothioate corresponding nucleotide"
  modified_base 17: /mod_base = "3' end (c11-PEg3-Nag3) modification"
aagaaagugaaagacca

SEQ ID NO: 1221 - DNA, 17 bp, artificial sequence
  sense strand of an RNAi agent
  modified_base 3,5,7,9,11,13,15,17: /mod_base = "2'-deoxy-2'-fluoro corresponding nucleoside"
  modified_base 4,6,8,10,12,14,16: /mod_base = "2'-O-methyl corresponding nucleoside"
  modified_base 1,2: /mod_base = "2'-MOE nucleotide"
  modified_base 2,3: /mod_base = "5'-phosphorothioate corresponding nucleotide"
  modified_base 17: /mod_base = "3' end (c11-PEg3-Nag3) modification"
aagaaagugaaagacca

SEQ ID NO: 1222 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-Ser) modification"
uauaugcccaagaaagugaaagacca

SEQ ID NO: 1223 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6)(NH2-Ser) modification"
uauaugcccaagaaagugaaagacca

SEQ ID NO: 1224 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6)(NH2-Ser)3 modification"
uauaugcccaagaaagugaaagacca

SEQ ID NO: 1225 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-SS-c6) modification"
uauaugcccaagaaagugaaagacca

SEQ ID NO: 1226 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6)(alk-c6-Ser) modification"
uauaugcccaagaaagugaaagacca

SEQ ID NO: 1227 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6)(alk-c6-Ser)3 modification"
uauaugcccaagaaagugaaagacca

SEQ ID NO: 1228 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (chol-tEg) modification"
uauaugcccaagaaagugaaagacca

SEQ ID NO: 1229 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 1: /mod_base = "5' end (chol-tEg) modification"
uauaugcccaagaaagugaaagacca

SEQ ID NO: 1230 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-Ser) modification"
uauaugcccaagaaagugaaagacca

SEQ ID NO: 1231 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-SS-c6) modification"
uauaugcccaagaaagugaaagacca

SEQ ID NO: 1232 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1233 - DNA, 26 bp, artificial sequence
  sense strand of an RNAi agent
  modified_base 2,4: /mod_base = "2'-hydroxy corresponding nucleoside"
  modified_base 14,15,16: /mod_base = "2'-deoxy-2'-fluoro corresponding nucleoside"
  modified_base 1,3,5,6,7,8,9,10,11,12,13,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1234 - DNA, 26 bp, artificial sequence
  sense strand of an RNAi agent
  modified_base 2,4: /mod_base = "2'-hydroxy corresponding nucleoside"
  modified_base 14,15: /mod_base = "2'-deoxy-2'-fluoro corresponding nucleoside"
  modified_base 1,3,5,6,7,8,9,10,11,12,13,16,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1235 - DNA, 26 bp, artificial sequence
  sense strand of an RNAi agent
  modified_base 2,4: /mod_base = "2'-hydroxy corresponding nucleoside"
  modified_base 16,17: /mod_base = "2'-deoxy-2'-fluoro corresponding nucleoside"
  modified_base 1,3,5,6,7,8,9,10,11,12,13,14,15,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1236 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24: /mod_base = "2'-O-methyl corresponding nucleoside"
  modified_base 25,26: /mod_base = "2'-MOE nucleotide"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1237 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 26: /mod_base = "3' end (Nag13) modification"
uaugcccaagaaagugaaagaccaau

SEQ ID NO: 1238 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 26: /mod_base = "3' end (Nag13) modification"
uaugcccaagaaagugaaagaccuau

SEQ ID NO: 1239 - DNA, 26 bp, artificial sequence
  sense strand of an RNAi agent
  modified_base 25: /mod_base = "2'-hydroxy corresponding nucleoside"
  modified_base 12,14: /mod_base = "2'-deoxy-2'-fluoro corresponding nucleoside"
  modified_base 1,2,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 26: /mod_base = "3' end (Nag13) modification"
uaugcccaagaaagugaaagaccuau

SEQ ID NO: 1240 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 6,7: /mod_base = "5'-phosphorothioate corresponding nucleotide"
  modified_base 26: /mod_base = "3' end (Nag13) modification"
uauaugcccaagaaagugaaagacca

SEQ ID NO: 1241 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 5,6: /mod_base = "5'-phosphorothioate corresponding nucleotide"
  modified_base 26: /mod_base = "3' end (Nag13) modification"
uauaugcccaagaaagugaaagacca

SEQ ID NO: 1242 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7: /mod_base = "5'-phosphorothioate corresponding nucleotide"
  modified_base 26: /mod_base = "3' end (Nag13) modification"
uauaugcccaagaaagugaaagacca

SEQ ID NO: 1243 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 8: /mod_base = "5'-phosphorothioate corresponding nucleotide"
  modified_base 26: /mod_base = "3' end (Nag13) modification"
uauaugcccaagaaagugaaagacca

SEQ ID NO: 1244 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 1: /mod_base = "5' end (NH2-c6)(NH2-Ser) modification"
  modified_base 26: /mod_base = "3' end (Ser-NH2)(c6-NH2) modification"
uaugcccaagaaagugaaagaccuau

SEQ ID NO: 1245 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 1: /mod_base = "5' end (alk-c6-c6)(alk-c6-Ser) modification"
  modified_base 26: /mod_base = "3' end (Ser-c6-alk)(c6-c6-alk) modification"
uaugcccaagaaagugaaagaccuau

SEQ ID NO: 1246 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 1: /mod_base = "5' end (NH2-c6) modification"
  modified_base 26: /mod_base = "3' end (c6-NH2) modification"
uaugcccaagaaagugaaagaccuau

SEQ ID NO: 1247 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 1: /mod_base = "5' end (alk-c6-c6) modification"
  modified_base 26: /mod_base = "3' end (c6-c6-alk) modification"
uaugcccaagaaagugaaagaccuau

SEQ ID NO: 1248 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6,24,25: /mod_base = "5'-phosphorothioate corresponding nucleotide"
  modified_base 26: /mod_base = "3' end (Nag13) modification"
uaugcccaagaaagugaaagaccuau

SEQ ID NO: 1249 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,26: /mod_base = "2'-O-methyl corresponding nucleoside"
  modified_base 24: /mod_base = "3'-3'-linked nucleotide"
  modified_base 5,6: /mod_base = "5'-phosphorothioate corresponding nucleotide"
  modified_base 26: /mod_base = "3' end (Nag13) modification"
uaugcccaagaaagugaaagaccaau

SEQ ID NO: 1250 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,26: /mod_base = "2'-O-methyl corresponding nucleoside"
  modified_base 23,24: /mod_base = "2'-MOE nucleotide"
  modified_base 5,6: /mod_base = "5'-phosphorothioate corresponding nucleotide"
  modified_base 26: /mod_base = "3' end (Nag13) modification"
uaugcccaagaaagugaaagaccaau

SEQ ID NO: 1251 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6) modification"
uauaugcccaagaaagugaaagacca

SEQ ID NO: 1252 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6) modification"
uauaugcccaagaaagugaaagacca

SEQ ID NO: 1253 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6) modification"
uauaugcccaagaaagugaaagacca

SEQ ID NO: 1254 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6) modification"
uauaugcccaagaaagugaaagacca

SEQ ID NO: 1255 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-PEg5-Ser) modification"
uauaugcccaagaaagugaaagacca

SEQ ID NO: 1256 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-PEg5-c6)(alk-PEg5-Ser) modification"
uauaugcccaagaaagugaaagacca

SEQ ID NO: 1257 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-PEg5-Ser) modification"
uauaugcccaagaaagugaaagacca

SEQ ID NO: 1258 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-PEg5-c6) modification"
uauaugcccaagaaagugaaagacca

SEQ ID NO: 1259 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-PEg5-c6) modification"
uauaugcccaagaaagugaaagacca

SEQ ID NO: 1260 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 1: /mod_base = "5' end (alk-PEg5-c6) modification"
  modified_base 26: /mod_base = "3' end (c6-PEg5-alk) modification"
uaugcccaagaaagugaaagaccuau

SEQ ID NO: 1261 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "locked nucleotide"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1262 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,7,8,9,10,11,12,13,15,17,18,19,20,21,22,23,24,25: /mod_base = "2'-O-methyl corresponding nucleoside"
  modified_base 6,26: /mod_base = "locked nucleotide"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1263 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,7,8,9,10,11,12,13,15,17,18,19,20,21,22,23,24,25,26: /mod_base = "2'-O-methyl corresponding nucleoside"
  modified_base 6: /mod_base = "locked nucleotide"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1264 - DNA, 26 bp, artificial sequence
  sense strand of an RNAi agent
  modified_base 2: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,25,26: /mod_base = "2'-O-methyl corresponding nucleoside"
  modified_base 5,6: /mod_base = "5'-phosphorothioate corresponding nucleotide"
  modified_base 26: /mod_base = "3' end (Nag13) modification"
uaugcccaagaaagugaaagaccuau

SEQ ID NO: 1265 - DNA, 26 bp, artificial sequence
  sense strand of an RNAi agent
  modified_base 2: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 26: /mod_base = "3' end (Nag13) modification"
uaugcccaagaaagugaaagaccuau

SEQ ID NO: 1266 - DNA, 26 bp, artificial sequence
  sense strand of an RNAi agent
  modified_base 2: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,25,26: /mod_base = "2'-O-methyl corresponding nucleoside"
  modified_base 5,6: /mod_base = "5'-phosphorothioate corresponding nucleotide"
  modified_base 26: /mod_base = "3' end (Nag13) modification"
uaugcccaagaaagugaaagaccaau

SEQ ID NO: 1267 - DNA, 26 bp, artificial sequence
  sense strand of an RNAi agent
  modified_base 2: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,25,26: /mod_base = "2'-O-methyl corresponding nucleoside"
  modified_base 5,6: /mod_base = "5'-phosphorothioate corresponding nucleotide"
  modified_base 26: /mod_base = "3' end (Nag13) modification"
uaugcccaagaaagugaaagaccauu

SEQ ID NO: 1268 - DNA, 26 bp, artificial sequence
  sense strand of an RNAi agent
  modified_base 2: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,25,26: /mod_base = "2'-O-methyl corresponding nucleoside"
  modified_base 5,6: /mod_base = "5'-phosphorothioate corresponding nucleotide"
  modified_base 26: /mod_base = "3' end (Nag13) modification"
uaugcccaagaaagugaaagaccaua

SEQ ID NO: 1269 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 26: /mod_base = "3' end (Nag13) modification"
uaugcccaagaaagugaaagaccauu

SEQ ID NO: 1270 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 26: /mod_base = "3' end (Nag13) modification"
uaugcccaagaaagugaaagaccaua

SEQ ID NO: 1271 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,7,8,9,10,11,12,13,15,17,18,19,20,21,22,23,24,25,26: /mod_base = "2'-O-methyl corresponding nucleoside"
  modified_base 6: /mod_base = "locked nucleotide"
  modified_base 8: /mod_base = "5'-phosphorothioate corresponding nucleotide"
  modified_base 26: /mod_base = "3' end (Nag13) modification"
uauaugcccaagaaagugaaagacca

SEQ ID NO: 1272 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,7,8,9,10,11,12,13,15,17,18,19,20,21,22,23,24,25: /mod_base = "2'-O-methyl corresponding nucleoside"
  modified_base 6,26: /mod_base = "locked nucleotide"
  modified_base 8: /mod_base = "5'-phosphorothioate corresponding nucleotide"
  modified_base 26: /mod_base = "3' end (Nag13) modification"
uauaugcccaagaaagugaaagacca

SEQ ID NO: 1273 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-PEg13-c6) modification"
uauaugcccaagaaagugaaagacca

SEQ ID NO: 1274 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-PEg13-c6)(alk-PEg13-Ser) modification"
uauaugcccaagaaagugaaagacca

SEQ ID NO: 1275 - DNA, 26 bp, artificial sequence
  sense strand of an RNAi agent
  modified_base 3: /mod_base = "2'-hydroxy corresponding nucleoside"
  modified_base 14,16: /mod_base = "2'-deoxy-2'-fluoro corresponding nucleoside"
  modified_base 1,2,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6) modification"
uuagagcccaagaaagugaaagacca

SEQ ID NO: 1276 - DNA, 26 bp, artificial sequence
  sense strand of an RNAi agent
  modified_base 3: /mod_base = "2'-hydroxy corresponding nucleoside"
  modified_base 14,16: /mod_base = "2'-deoxy-2'-fluoro corresponding nucleoside"
  modified_base 1,2,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6) modification"
uuagagcccaagaaagugaaagacca

SEQ ID NO: 1277 - DNA, 26 bp, artificial sequence
  sense strand of an RNAi agent
  modified_base 3: /mod_base = "2'-hydroxy corresponding nucleoside"
  modified_base 14,16: /mod_base = "2'-deoxy-2'-fluoro corresponding nucleoside"
  modified_base 1,2,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6) modification"
uuauugcccaagaaagugaaagacca

SEQ ID NO: 1278 - DNA, 26 bp, artificial sequence
  sense strand of an RNAi agent
  modified_base 3: /mod_base = "2'-hydroxy corresponding nucleoside"
  modified_base 14,16: /mod_base = "2'-deoxy-2'-fluoro corresponding nucleoside"
  modified_base 1,2,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6) modification"
uuauugcccaagaaagugaaagacca

SEQ ID NO: 1279 - DNA, 26 bp, artificial sequence
  sense strand of an RNAi agent
  modified_base 3,4: /mod_base = "2'-hydroxy corresponding nucleoside"
  modified_base 14,16: /mod_base = "2'-deoxy-2'-fluoro corresponding nucleoside"
  modified_base 1,2,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6) modification"
uugaugcccaagaaagugaaagacca

SEQ ID NO: 1280 - DNA, 26 bp, artificial sequence
  sense strand of an RNAi agent
  modified_base 3,4: /mod_base = "2'-hydroxy corresponding nucleoside"
  modified_base 14,16: /mod_base = "2'-deoxy-2'-fluoro corresponding nucleoside"
  modified_base 1,2,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6) modification"
uugaugcccaagaaagugaaagacca

SEQ ID NO: 1281 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6) modification"
uuagagcccaagaaagugaaagacca

SEQ ID NO: 1282 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6) modification"
uuagagcccaagaaagugaaagacca

SEQ ID NO: 1283 - DNA, 26 bp, artificial sequence
  sense strand of an RNAi agent
  modified_base 2: /mod_base = "2'-hydroxy corresponding nucleoside"
  modified_base 14,16: /mod_base = "2'-deoxy-2'-fluoro corresponding nucleoside"
  modified_base 1,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (NH2-c6) modification"
uaugagcccaagaaagugaaagacca

SEQ ID NO: 1284 - DNA, 26 bp, artificial sequence
  sense strand of an RNAi agent
  modified_base 2: /mod_base = "2'-hydroxy corresponding nucleoside"
  modified_base 14,16: /mod_base = "2'-deoxy-2'-fluoro corresponding nucleoside"
  modified_base 1,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (alk-c6-c6) modification"
uaugagcccaagaaagugaaagacca

SEQ ID NO: 1285 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (c6-NH2) modification"
uauaugcccaagaaagugaaagacca

SEQ ID NO: 1286 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 26: /mod_base = "3' end (c6-NH2) modification"
uaugcccaagaaagugaaagaccuau

SEQ ID NO: 1287 - DNA, 26 bp, artificial sequence
  sense strand of an RNAi agent
  modified_base 2,4: /mod_base = "2'-hydroxy corresponding nucleoside"
  modified_base 6,8,10,11,14,16,18,20,22,24: /mod_base = "2'-deoxy-2'-fluoro corresponding nucleoside"
  modified_base 1,3,5,7,9,12,13,15,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
  modified_base 1: /mod_base = "5' end (chol-tEg) modification"
auagagcccaagaaagugaaagacca

SEQ ID NO: 1288 - DNA, 26 bp, artificial sequence
  sense strand of an RNAi agent
  modified_base 6,8,10,11,14,16,18,20,22,24: /mod_base = "2'-deoxy-2'-fluoro corresponding nucleoside"
  modified_base 1,2,3,4,5,7,9,12,13,15,17,19,21,23,25: /mod_base = "2'-O-methyl corresponding nucleoside"
  modified_base 26: /mod_base = "3'-3'-linked nucleotide"
  modified_base 6: /mod_base = "5'-phosphorothioate corresponding nucleotide"
  modified_base 1: /mod_base = "5' end (chol-tEg) modification"
uauaugcccaagaaagugaaagacca

SEQ ID NO: 1289 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag14) modification"
uauaugcccaagaaagugaaagacca

SEQ ID NO: 1290 - DNA, 26 bp, artificial sequence
  sense strand of an RNAi agent
  modified_base 1,24: /mod_base = "2'-hydroxy corresponding nucleoside"
  modified_base 11,13: /mod_base = "2'-deoxy-2'-fluoro corresponding nucleoside"
  modified_base 2,3,4,5,6,7,8,9,10,12,14,15,16,17,18,19,20,21,22,23,25,26: /mod_base = "2'-O-methyl corresponding nucleoside"
  modified_base 4,5: /mod_base = "5'-phosphorothioate corresponding nucleotide"
  modified_base 26: /mod_base = "3' end (Nag13) modification"
augcccaagaaagugaaagaccuauu

SEQ ID NO: 1291 - DNA, 26 bp, artificial sequence
  sense strand of an RNAi agent
  modified_base 1,24,25: /mod_base = "2'-hydroxy corresponding nucleoside"
  modified_base 11,13: /mod_base = "2'-deoxy-2'-fluoro corresponding nucleoside"
  modified_base 2,3,4,5,6,7,8,9,10,12,14,15,16,17,18,19,20,21,22,23,26: /mod_base = "2'-O-methyl corresponding nucleoside"
  modified_base 4,5: /mod_base = "5'-phosphorothioate corresponding nucleotide"
  modified_base 26: /mod_base = "3' end (Nag13) modification"
augcccaagaaagugaaagaccugau

SEQ ID NO: 1292 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag15) modification"
uauaugcccaagaaagugaaagacca

SEQ ID NO: 1293 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag16) modification"
uauaugcccaagaaagugaaagacca

SEQ ID NO: 1294 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag17) modification"
uauaugcccaagaaagugaaagacca

SEQ ID NO: 1295 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag18) modification"
uauaugcccaagaaagugaaagacca

SEQ ID NO: 1296 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag18) modification"
uauaugcccaagaaagugaaagacca

SEQ ID NO: 1297 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag18) modification"
uauaugcccaagaaagugaaagacca

SEQ ID NO: 1298 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 26: /mod_base = "3' end (Nag18) modification"
uaugcccaagaaagugaaagaccuau

SEQ ID NO: 1299 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag19) modification"
uauaugcccaagaaagugaaagacca

SEQ ID NO: 1300 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag19) modification"
uauaugcccaagaaagugaaagacca

SEQ ID NO: 1301 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag19) modification"
uauaugcccaagaaagugaaagacca

SEQ ID NO: 1302 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 26: /mod_base = "3' end (Nag19) modification"
uaugcccaagaaagugaaagaccuau

SEQ ID NO: 1303 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag20) modification"
uauaugcccaagaaagugaaagacca

SEQ ID NO: 1304 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag20) modification"
uauaugcccaagaaagugaaagacca

SEQ ID NO: 1305 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag20) modification"
uauaugcccaagaaagugaaagacca

SEQ ID NO: 1306 - DNA, 26 bp, artificial sequence
  sense strand of an RNAi agent
  modified_base 2,25: /mod_base = "2'-hydroxy corresponding nucleoside"
  modified_base 12,14: /mod_base = "2'-deoxy-2'-fluoro corresponding nucleoside"
  modified_base 1,3,4,5,6,7,8,9,10,11,13,15,16,17,18,19,20,21,22,23,24,26: /mod_base = "2'-O-methyl corresponding nucleoside"
  modified_base 5,6: /mod_base = "5'-phosphorothioate corresponding nucleotide"
  modified_base 26: /mod_base = "3' end (Nag20) modification"
uaugcccaagaaagugaaagaccuau

SEQ ID NO: 1307 - RNA, 26 nt, artificial sequence
  antisense strand of an RNAi agent
uggucuuucacuuucuugggcuauau

SEQ ID NO: 1308 - RNA, 17 nt, artificial sequence
  antisense strand of an RNAi agent
ucuuucacuuucuuggg

SEQ ID NO: 1309 - RNA, 17 nt, artificial sequence
  antisense strand of an RNAi agent
acuuucacuuucuuggg

SEQ ID NO: 1310 - RNA, 26 nt, artificial sequence
  antisense strand of an RNAi agent
uggucuuucacuuucuugggcauuau

SEQ ID NO: 1311 - RNA, 26 nt, artificial sequence
  antisense strand of an RNAi agent
uggucuuucacuuucuugggcucaua

SEQ ID NO: 1312 - RNA, 26 nt, artificial sequence
  antisense strand of an RNAi agent
aggucuuucacuuucuugggcucuau

SEQ ID NO: 1313 - RNA, 25 nt, artificial sequence
  antisense strand of an RNAi agent
ggucuuucacuuucuugggcucuau

SEQ ID NO: 1314 - RNA, 26 nt, artificial sequence
  antisense strand of an RNAi agent
ucgucuuucacuuucuugggcucuau

SEQ ID NO: 1315 - RNA, 26 nt, artificial sequence
  antisense strand of an RNAi agent
uagucuuucacuuucuugggcucuau

SEQ ID NO: 1316 - RNA, 26 nt, artificial sequence
  antisense strand of an RNAi agent
uugucuuucacuuucuugggcucuau

SEQ ID NO: 1317 - DNA, 26 bp, artificial sequence
  sense strand of an RNAi agent
  modified_base 1, 3-26: /mod_base = "2'-hydroxy corresponding nucleoside"
atagagcccaagaaagugaaagacca

SEQ ID NO: 1318 - RNA, 17 nt, artificial sequence
  sense strand of an RNAi agent
cccaagaaagugaaagu

SEQ ID NO: 1319 - RNA, 26 nt, artificial sequence
  sense strand of an RNAi agent
gagcccaagaaagugaaagaccuauu

SEQ ID NO: 1320 - RNA, 26 nt, artificial sequence
  sense strand of an RNAi agent
gagcccaagaaagugaaagaccugau

SEQ ID NO: 1321 - RNA, 26 nt, artificial sequence
  sense strand of an RNAi agent
uauaugcccaagaaagugaaagaccu

SEQ ID NO: 1322 - DNA, 26 bp, artificial sequence
  antisense strand of an RNAi agent
  modified_base 25: /mod_base = "2'-hydroxy corresponding nucleoside"
  modified_base 2,3,8,10,14: /mod_base = "2'-deoxy-2'-fluoro corresponding nucleoside"
  modified_base 1,4,5,6,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 1323 - DNA, 26 bp, artificial sequence
  antisense strand of an RNAi agent
  modified_base 25: /mod_base = "2'-hydroxy corresponding nucleoside"
  modified_base 2,3,8,9,11,14: /mod_base = "2'-deoxy-2'-fluoro corresponding nucleoside"
  modified_base 1,4,5,6,7,10,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 1324 - DNA, 26 bp, artificial sequence
  antisense strand of an RNAi agent
  modified_base 25: /mod_base = "2'-hydroxy corresponding nucleoside"
  modified_base 2,8,9,11,14: /mod_base = "2'-deoxy-2'-fluoro corresponding nucleoside"
  modified_base 1,3,4,5,6,7,10,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 1325 - DNA, 26 bp, artificial sequence
  antisense strand of an RNAi agent
  modified_base 25: /mod_base = "2'-hydroxy corresponding nucleoside"
  modified_base 2,5,8,9,11,14: /mod_base = "2'-deoxy-2'-fluoro corresponding nucleoside"
  modified_base 1,3,4,6,7,10,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 1326 - DNA, 26 bp, artificial sequence
  antisense strand of an RNAi agent
  modified_base 25: /mod_base = "2'-hydroxy corresponding nucleoside"
  modified_base 2,5,9,11,14: /mod_base = "2'-deoxy-2'-fluoro corresponding nucleoside"
  modified_base 1,3,4,6,7,8,10,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 1327 - DNA, 26 bp, artificial sequence
  antisense strand of an RNAi agent
  modified_base 25: /mod_base = "2'-hydroxy corresponding nucleoside"
  modified_base 2,3,9,11,14: /mod_base = "2'-deoxy-2'-fluoro corresponding nucleoside"
  modified_base 1,4,5,6,7,8,10,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 1328 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,24,26: /mod_base = "2'-O-methyl corresponding nucleoside"
  modified_base 23: /mod_base = "3'-3'-linked nucleotide"
  modified_base 2,3,22,23: /mod_base = "5'-phosphorothioate corresponding nucleotide"
uggucuuucacuuucuugggcuauau

SEQ ID NO: 1329 - DNA, 19 bp, artificial sequence
  antisense strand of an RNAi agent
  modified_base 2,4,6,8,10,12,14: /mod_base = "2'-deoxy-2'-fluoro corresponding nucleoside"
  modified_base 1,3,5,7,9,11,13,15: /mod_base = "2'-O-methyl corresponding nucleoside"
  modified_base 18,19: /mod_base = "abasic corresponding nucleoside"
  modified_base 16,17: /mod_base = "2'-MOE nucleotide"
  modified_base 2,3: /mod_base = "5'-phosphorothioate corresponding nucleotide"
  modified_base 19: /mod_base = "3' end thioate(PaZ) modification"
ucuuucacuuucuugggnn

SEQ ID NO: 1330 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3,16,17: /mod_base = "5'-phosphorothioate corresponding nucleotide"
  modified_base 19: /mod_base = "3' end thioate(PaZ) modification"
ucuuucacuuucuugggnn

SEQ ID NO: 1331 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3,16,17: /mod_base = "5'-phosphorothioate corresponding nucleotide"
  modified_base 19: /mod_base = "3' end (PaZ) modification"
ucuuucacuuucuugggnn

SEQ ID NO: 1332 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
acuuucacuuucuugggnn

SEQ ID NO: 1333 - DNA, 19 bp, artificial sequence
  antisense strand of an RNAi agent
  modified_base 2,6,8,12,14: /mod_base = "2'-deoxy-2'-fluoro corresponding nucleoside"
  modified_base 1,3,4,5,7,9,10,11,13,15: /mod_base = "2'-O-methyl corresponding nucleoside"
  modified_base 18,19: /mod_base = "abasic corresponding nucleoside"
  modified_base 16,17: /mod_base = "2'-MOE nucleotide"
  modified_base 2,3: /mod_base = "5'-phosphorothioate corresponding nucleotide"
  modified_base 19: /mod_base = "3' end thioate(PaZ) modification"
ucuuucacuuucuugggnn

SEQ ID NO: 1334 - DNA, 19 bp, artificial sequence
  antisense strand of an RNAi agent
  modified_base 2,6,8,12,14: /mod_base = "2'-deoxy-2'-fluoro corresponding nucleoside"
  modified_base 1,3,4,5,7,9,10,11,13,15,16,17: /mod_base = "2'-O-methyl corresponding nucleoside"
  modified_base 18,19: /mod_base = "abasic corresponding nucleoside"
  modified_base 2,3: /mod_base = "5'-phosphorothioate corresponding nucleotide"
  modified_base 19: /mod_base = "3' end thioate(PaZ) modification"
acuuucacuuucuugggnn

SEQ ID NO: 1335 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 1336 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
uggucuuucacuuucuugggcauuau

SEQ ID NO: 1337 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
uggucuuucacuuucuugggcucaua

SEQ ID NO: 1338 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 25: /mod_base = "3'-3'-linked nucleotide"
  modified_base 2,3,22,23: /mod_base = "5'-phosphorothioate corresponding nucleotide"
uggucuuucacuuucuugggcucuau

SEQ ID NO: 1339 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
aggucuuucacuuucuugggcucuau

SEQ ID NO: 1340 - DNA, 26 bp, artificial sequence
  antisense strand of an RNAi agent
  modified_base 2,8,10,14: /mod_base = "2'-deoxy-2'-fluoro corresponding nucleoside"
  modified_base 3,4,5,6,7,9,11,12,13,15,16,17,18,19,20,21,22,23,24,25,26: /mod_base = "2'-O-methyl corresponding nucleoside"
  modified_base 1: /mod_base = "3'-3'-linked nucleotide"
  modified_base 2,3,22,23: /mod_base = "5'-phosphorothioate corresponding nucleotide"
aggucuuucacuuucuugggcucuau

SEQ ID NO: 1341 - DNA, 26 bp, artificial sequence
  antisense strand of an RNAi agent
  modified_base 2,8,10,14: /mod_base = "2'-deoxy-2'-fluoro corresponding nucleoside"
  modified_base 3,4,5,6,7,9,11,12,13,15,16,17,18,19,20,21,22,23,24,25,26: /mod_base = "2'-O-methyl corresponding nucleoside"
  modified_base 1: /mod_base = "abasic corresponding nucleoside"
  modified_base 2,3,22,23: /mod_base = "5'-phosphorothioate corresponding nucleotide"
nggucuuucacuuucuugggcucuau

SEQ ID NO: 1342 - DNA, 26 bp, artificial sequence
  antisense strand of an RNAi agent
  modified_base 2,8,10,14: /mod_base = "2'-deoxy-2'-fluoro corresponding nucleoside"
  modified_base 3,4,5,6,7,9,11,12,13,15,16,17,18,19,20,21,22,23,24,25,26: /mod_base = "2'-O-methyl corresponding nucleoside"
  modified_base 1: /mod_base = "abasic corresponding nucleoside"
  modified_base 1: /mod_base = "3'-3'-linked nucleotide"
  modified_base 2,3,22,23: /mod_base = "5'-phosphorothioate corresponding nucleotide"
nggucuuucacuuucuugggcucuau

SEQ ID NO: 1343 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 1: /mod_base = "3'-3'-linked nucleotide"
  modified_base 2,3,22,23: /mod_base = "5'-phosphorothioate corresponding nucleotide"
uggucuuucacuuucuugggcucuau

SEQ ID NO: 1344 - DNA, 26 bp, artificial sequence
  antisense strand of an RNAi agent
  modified_base 2,8,10,14: /mod_base = "2'-deoxy-2'-fluoro corresponding nucleoside"
  modified_base 3,4,5,6,7,9,11,12,13,15,16,17,18,19,20,21,22,23,24,25,26: /mod_base = "2'-O-methyl corresponding nucleoside"
  modified_base 1: /mod_base = "3'-O-methoxy nucleotide"
  modified_base 2,3,22,23: /mod_base = "5'-phosphorothioate corresponding nucleotide"
uggucuuucacuuucuugggcucuau

SEQ ID NO: 1345 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
ucgucuuucacuuucuugggcucuau

SEQ ID NO: 1346 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
uagucuuucacuuucuugggcucuau

SEQ ID NO: 1347 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
uugucuuucacuuucuugggcucuau

SEQ ID NO: 1348 - DNA, 26 bp, artificial sequence
  antisense strand of an RNAi agent
  modified_base 8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
uggucuuucacuuucuugggcucuau

SEQ ID NO: 1349 - DNA, 26 bp, artificial sequence
  sense strand of an RNAi agent
  modified_base 14,16: /mod_base = "2'-deoxy-2'-fluoro corresponding nucleoside"
  modified_base 1,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
atagagcccaagaaagugaaagacca

SEQ ID NO: 1350 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
auagagcccaagaaagugaaagacca

SEQ ID NO: 1351 - DNA, 17 bp, artificial sequence
  sense strand of an RNAi agent
  modified_base 5,7: /mod_base = "2'-deoxy-2'-fluoro corresponding nucleoside"
  modified_base 1,2,3,4,6,8,9,10,11,12,13,14,15,16,17: /mod_base = "2'-O-methyl corresponding nucleoside"
  modified_base 2,3: /mod_base = "5'-phosphorothioate corresponding nucleotide"
  modified_base 17: /mod_base = "3' end (Nag13) modification"
cccaagaaagugaaaga

SEQ ID NO: 1352 - DNA, 18 bp, artificial sequence
  sense strand of an RNAi agent
  modified_base 6,8: /mod_base = "2'-deoxy-2'-fluoro corresponding nucleoside"
  modified_base 2,3,4,5,7,9,10,11,12,13,14,15,16,17,18: /mod_base = "2'-O-methyl corresponding nucleoside"
  modified_base 1: /mod_base = "abasic corresponding nucleoside"
  modified_base 2,3: /mod_base = "5'-phosphorothioate corresponding nucleotide"
  modified_base 18: /mod_base = "3' end (Nag13) modification"
ncccaagaaagugaaaga

SEQ ID NO: 1353 - DNA, 19 bp, artificial sequence
  sense strand of an RNAi agent
  modified_base 7,9: /mod_base = "2'-deoxy-2'-fluoro corresponding nucleoside"
  modified_base 3,4,5,6,8,10,11,12,13,14,15,16,17,18,19: /mod_base = "2'-O-methyl corresponding nucleoside"
  modified_base 1,2: /mod_base = "abasic corresponding nucleoside"
  modified_base 2,3: /mod_base = "5'-phosphorothioate corresponding nucleotide"
  modified_base 19: /mod_base = "3' end (Nag13) modification"
nncccaagaaagugaaaga

SEQ ID NO: 1354 - DNA, 17 bp, artificial sequence
  sense strand of an RNAi agent
  modified_base 5,7: /mod_base = "2'-deoxy-2'-fluoro corresponding nucleoside"
  modified_base 3,4,6,8,9,10,11,12,13,14,15: /mod_base = "2'-O-methyl corresponding nucleoside"
  modified_base 1,2,16,17: /mod_base = "2'-MOE nucleotide"
  modified_base 2,3: /mod_base = "5'-phosphorothioate corresponding nucleotide"
  modified_base 17: /mod_base = "3' end (Nag13) modification"
cccaagaaagugaaaga

SEQ ID NO: 1355 - DNA, 17 bp, artificial sequence
  sense strand of an RNAi agent
  modified_base 5,7: /mod_base = "2'-deoxy-2'-fluoro corresponding nucleoside"
  modified_base 1,2,3,4,6,8,9,10,11,12,13,14,15: /mod_base = "2'-O-methyl corresponding nucleoside"
  modified_base 16,17: /mod_base = "2'-MOE nucleotide"
  modified_base 2,3: /mod_base = "5'-phosphorothioate corresponding nucleotide"
  modified_base 17: /mod_base = "3' end (Nag13) modification"
cccaagaaagugaaaga

SEQ ID NO: 1356 - DNA, 17 bp, artificial sequence
  sense strand of an RNAi agent
  modified_base 5,7: /mod_base = "2'-deoxy-2'-fluoro corresponding nucleoside"
  modified_base 1,2,3,4,6,8,9,10,11,12,13,14,15,16,17: /mod_base = "2'-O-methyl corresponding nucleoside"
  modified_base 2,3: /mod_base = "5'-phosphorothioate corresponding nucleotide"
  modified_base 17: /mod_base = "3' end (Nag13) modification"
cccaagaaagugaaagu

SEQ ID NO: 1357 - DNA, 26 bp, artificial sequence
  sense strand of an RNAi agent
  modified_base 24: /mod_base = "2'-hydroxy corresponding nucleoside"
  modified_base 11,13: /mod_base = "2'-deoxy-2'-fluoro corresponding nucleoside"
  modified_base 1,2,3,4,5,6,7,8,9,10,12,14,15,16,17,18,19,20,21,22,23,25,26: /mod_base = "2'-O-methyl corresponding nucleoside"
  modified_base 4,5: /mod_base = "5'-phosphorothioate corresponding nucleotide"
  modified_base 26: /mod_base = "3' end (Nag13) modification"
gagcccaagaaagugaaagaccuauu

SEQ ID NO: 1358 - DNA, 26 bp, artificial sequence
  sense strand of an RNAi agent
  modified_base 24,25: /mod_base = "2'-hydroxy corresponding nucleoside"
  modified_base 11,13: /mod_base = "2'-deoxy-2'-fluoro corresponding nucleoside"
  modified_base 1,2,3,4,5,6,7,8,9,10,12,14,15,16,17,18,19,20,21,22,23,26: /mod_base = "2'-O-methyl corresponding nucleoside"
  modified_base 4,5: /mod_base = "5'-phosphorothioate corresponding nucleotide"
  modified_base 26: /mod_base = "3' end (Nag13) modification"
gagcccaagaaagugaaagaccugau

SEQ ID NO: 1359 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1360 - DNA, 26 bp, artificial sequence
  sense strand of an RNAi agent
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1361 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1362 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
uauaugcccaagaaagugaaagacca

SEQ ID NO: 1363 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag21) modification"
uauaugcccaagaaagugaaagacca

SEQ ID NO: 1364 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag21) modification"
uauaugcccaagaaagugaaagacca

SEQ ID NO: 1365 - DNA, 26 bp, artificial sequence
  sense strand of an RNAi agent
  modified_base 2,4: /mod_base = "2'-hydroxy corresponding nucleoside"
  modified_base 14,16: /mod_base = "2'-deoxy-2'-fluoro corresponding nucleoside"
  modified_base 1,3,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag23) modification"
uauaugcccaagaaagugaaagacca

SEQ ID NO: 1366 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag23) modification"
uauaugcccaagaaagugaaagacca

SEQ ID NO: 1367 - DNA, 26 bp, artificial sequence
  sense strand of an RNAi agent
  modified_base 14,16: /mod_base = "2'-deoxy-2'-fluoro corresponding nucleoside"
  modified_base 1,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1368 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1369 - DNA, 26 bp, artificial sequence
  sense strand of an RNAi agent
  modified_base 14,16: /mod_base = "2'-deoxy-2'-fluoro corresponding nucleoside"
  modified_base 1,3,4,5,6,7,8,9,10,11,12,13,15,17,18,19,20,21,22,23,24,25,26: /mod_base = "2'-O-methyl corresponding nucleoside"
  modified_base 2: /mod_base = "3'-3'-linked nucleotide"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1370 - DNA, 26 bp, artificial sequence
  sense strand of an RNAi agent
  modified_base 14,16: /mod_base = "2'-deoxy-2'-fluoro corresponding nucleoside"
  modified_base 1,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1371 - DNA, 26 bp, artificial sequence
  sense strand of an RNAi agent
  modified_base 14,16: /mod_base = "2'-deoxy-2'-fluoro corresponding nucleoside"
  modified_base 1,3,4,5,6,7,8,9,10,11,12,13,15,17,18,19,20,21,22,23,24,25,26: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1372 - DNA, 26 bp, artificial sequence
  sense strand of an RNAi agent
  modified_base 14,16: /mod_base = "2'-deoxy-2'-fluoro corresponding nucleoside"
  modified_base 1,3,4,5,6,7,8,9,10,11,12,13,15,17,18,19,20,21,22,23,24,25: /mod_base = "2'-O-methyl corresponding nucleoside"
  modified_base 26: /mod_base = "3'-O-methoxy nucleotide"
  modified_base 7,8: /mod_base = "5'-phosphorothioate corresponding nucleotide"
  modified_base 26: /mod_base = "3' end (Nag13) modification"
uauaugcccaagaaagugaaagacca

SEQ ID NO: 1373 - DNA, 26 bp, artificial sequence
  sense strand of an RNAi agent
  modified_base 14,16: /mod_base = "2'-deoxy-2'-fluoro corresponding nucleoside"
  modified_base 1,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uauaugcccaagaaagugaaagaccu

SEQ ID NO: 1374 - DNA, 26 bp, artificial sequence
  sense strand of an RNAi agent
  modified_base 14,16: /mod_base = "2'-deoxy-2'-fluoro corresponding nucleoside"
  modified_base 1,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uaugagcccaagaaagugaaagacca

SEQ ID NO: 1375 - RNA, 19 nt, artificial sequence
  sense strand of an RNAi agent
cccuggugugcuaccaccc

SEQ ID NO: 1376 - RNA, 19 nt, artificial sequence
  sense strand of an RNAi agent
ccuggugugcuaccacccc

SEQ ID NO: 1377 - RNA, 19 nt, artificial sequence
  sense strand of an RNAi agent
cuggugugcuaccaccccc

SEQ ID NO: 1378 - RNA, 19 nt, artificial sequence
  sense strand of an RNAi agent
uuggagcccaagaaaguga

SEQ ID NO: 1379 - RNA, 19 nt, artificial sequence
  sense strand of an RNAi agent
uggagcccaagaaagugaa

SEQ ID NO: 1380 - RNA, 19 nt, artificial sequence
  sense strand of an RNAi agent
ggagcccaagaaagugaaa

SEQ ID NO: 1381 - RNA, 19 nt, artificial sequence
  sense strand of an RNAi agent
gagcccaagaaagugaaag

SEQ ID NO: 1382 - RNA, 19 nt, artificial sequence
  sense strand of an RNAi agent
agcccaagaaagugaaaga

SEQ ID NO: 1383 - RNA, 19 nt, artificial sequence
  sense strand of an RNAi agent
gcccaagaaagugaaagac

SEQ ID NO: 1384 - RNA, 19 nt, artificial sequence
  sense strand of an RNAi agent
cccaagaaagugaaagacc

SEQ ID NO: 1385 - RNA, 19 nt, artificial sequence
  sense strand of an RNAi agent
ccaagaaagugaaagacca

SEQ ID NO: 1386 - RNA, 19 nt, artificial sequence
  sense strand of an RNAi agent
caagaaagugaaagaccac

SEQ ID NO: 1387 - RNA, 19 nt, artificial sequence
  sense strand of an RNAi agent
gugcuuugagccucagcuu

SEQ ID NO: 1388 - RNA, 19 nt, artificial sequence
  sense strand of an RNAi agent
ugcuuugagccucagcuuc

SEQ ID NO: 1389 - RNA, 19 nt, artificial sequence
  sense strand of an RNAi agent
gcuuugagccucagcuucu

SEQ ID NO: 1390 - RNA, 19 nt, artificial sequence
  sense strand of an RNAi agent
uuugagccucagcuucucc

SEQ ID NO: 1391 - RNA, 19 nt, artificial sequence
  sense strand of an RNAi agent
cuggccagccaggccugcc

SEQ ID NO: 1392 - RNA, 19 nt, artificial sequence
  sense strand of an RNAi agent
ccaccaguucgagggggcg

SEQ ID NO: 1393 - RNA, 19 nt, artificial sequence
  sense strand of an RNAi agent
gggcuguggugaccgcaac

SEQ ID NO: 1394 - RNA, 19 nt, artificial sequence
  sense strand of an RNAi agent
ggcuguggugaccgcaaca

SEQ ID NO: 1395 - RNA, 19 nt, artificial sequence
  sense strand of an RNAi agent
gcuguggugaccgcaacaa

SEQ ID NO: 1396 - RNA, 19 nt, artificial sequence
  sense strand of an RNAi agent
cuguggugaccgcaacaag

SEQ ID NO: 1397 - RNA, 19 nt, artificial sequence
  sense strand of an RNAi agent
uguggugaccgcaacaagc

SEQ ID NO: 1398 - RNA, 19 nt, artificial sequence
  sense strand of an RNAi agent
guggugaccgcaacaagcc

SEQ ID NO: 1399 - RNA, 19 nt, artificial sequence
  sense strand of an RNAi agent
uggugaccgcaacaagcca

SEQ ID NO: 1400 - RNA, 19 nt, artificial sequence
  sense strand of an RNAi agent
gaacucaauaaagugcuuu

SEQ ID NO: 1401 - RNA, 19 nt, artificial sequence
  sense strand of an RNAi agent
aacucaauaaagugcuuug

SEQ ID NO: 1402 - RNA, 19 nt, artificial sequence
  sense strand of an RNAi agent
acucaauaaagugcuuuga

SEQ ID NO: 1403 - RNA, 19 nt, artificial sequence
  sense strand of an RNAi agent
cucaauaaagugcuuugaa

SEQ ID NO: 1404 - RNA, 19 nt, artificial sequence
  sense strand of an RNAi agent
ucaauaaagugcuuugaaa

SEQ ID NO: 1405 - RNA, 19 nt, artificial sequence
  sense strand of an RNAi agent
caauaaagugcuuugaaaa

SEQ ID NO: 1406 - RNA, 19 nt, artificial sequence
  sense strand of an RNAi agent
aauaaagugcuuugaaaau

SEQ ID NO: 1407 - RNA, 19 nt, artificial sequence
  antisense strand of an RNAi agent
gggugguagcacaccaggg

SEQ ID NO: 1408 - RNA, 19 nt, artificial sequence
  antisense strand of an RNAi agent
ggggugguagcacaccagg

SEQ ID NO: 1409 - RNA, 19 nt, artificial sequence
  antisense strand of an RNAi agent
gggggugguagcacaccag

SEQ ID NO: 1410 - RNA, 19 nt, artificial sequence
  antisense strand of an RNAi agent
ucacuuucuugggcuccaa

SEQ ID NO: 1411 - RNA, 19 nt, artificial sequence
  antisense strand of an RNAi agent
uucacuuucuugggcucca

SEQ ID NO: 1412 - RNA, 19 nt, artificial sequence
  antisense strand of an RNAi agent
uuucacuuucuugggcucc

SEQ ID NO: 1413 - RNA, 19 nt, artificial sequence
  antisense strand of an RNAi agent
cuuucacuuucuugggcuc

SEQ ID NO: 1414 - RNA, 19 nt, artificial sequence
  antisense strand of an RNAi agent
ucuuucacuuucuugggcu

SEQ ID NO: 1415 - RNA, 19 nt, artificial sequence
  antisense strand of an RNAi agent
gucuuucacuuucuugggc

SEQ ID NO: 1416 - RNA, 19 nt, artificial sequence
  antisense strand of an RNAi agent
ggucuuucacuuucuuggg

SEQ ID NO: 1417 - RNA, 19 nt, artificial sequence
  antisense strand of an RNAi agent
uggucuuucacuuucuugg

SEQ ID NO: 1418 - RNA, 19 nt, artificial sequence
  antisense strand of an RNAi agent
guggucuuucacuuucuug

SEQ ID NO: 1419 - RNA, 19 nt, artificial sequence
  antisense strand of an RNAi agent
aagcugaggcucaaagcac

SEQ ID NO: 1420 - RNA, 19 nt, artificial sequence
  antisense strand of an RNAi agent
gaagcugaggcucaaagca

SEQ ID NO: 1421 - RNA, 19 nt, artificial sequence
  antisense strand of an RNAi agent
agaagcugaggcucaaagc

SEQ ID NO: 1422 - RNA, 19 nt, artificial sequence
  antisense strand of an RNAi agent
ggagaagcugaggcucaaa

SEQ ID NO: 1423 - RNA, 19 nt, artificial sequence
  antisense strand of an RNAi agent
ggcaggccuggcuggccag

SEQ ID NO: 1424 - RNA, 19 nt, artificial sequence
  antisense strand of an RNAi agent
cgcccccucgaacuggugg

SEQ ID NO: 1425 - RNA, 19 nt, artificial sequence
  antisense strand of an RNAi agent
guugcggucaccacagccc

SEQ ID NO: 1426 - RNA, 19 nt, artificial sequence
  antisense strand of an RNAi agent
uguugcggucaccacagcc

SEQ ID NO: 1427 - RNA, 19 nt, artificial sequence
  antisense strand of an RNAi agent
uuguugcggucaccacagc

SEQ ID NO: 1428 - RNA, 19 nt, artificial sequence
  antisense strand of an RNAi agent
cuuguugcggucaccacag

SEQ ID NO: 1429 - RNA, 19 nt, artificial sequence
  antisense strand of an RNAi agent
gcuuguugcggucaccaca

SEQ ID NO: 1430 - RNA, 19 nt, artificial sequence
  antisense strand of an RNAi agent
ggcuuguugcggucaccac

SEQ ID NO: 1431 - RNA, 19 nt, artificial sequence
  antisense strand of an RNAi agent
uggcuuguugcggucacca

SEQ ID NO: 1432 - RNA, 19 nt, artificial sequence
  antisense strand of an RNAi agent
aaagcacuuuauugaguuc

SEQ ID NO: 1433 - RNA, 19 nt, artificial sequence
  antisense strand of an RNAi agent
caaagcacuuuauugaguu

SEQ ID NO: 1434 - RNA, 19 nt, artificial sequence
  antisense strand of an RNAi agent
ucaaagcacuuuauugagu

SEQ ID NO: 1435 - RNA, 19 nt, artificial sequence
  antisense strand of an RNAi agent
uucaaagcacuuuauugag

SEQ ID NO: 1436 - RNA, 19 nt, artificial sequence
  antisense strand of an RNAi agent
uuucaaagcacuuuauuga

SEQ ID NO: 1437 - RNA, 19 nt, artificial sequence
  antisense strand of an RNAi agent
uuuucaaagcacuuuauug

SEQ ID NO: 1438 - RNA, 19 nt, artificial sequence
  antisense strand of an RNAi agent
auuuucaaagcacuuuauu

SEQ ID NO: 1439 - DNA, 20 bp, artificial sequence
  sense strand of an RNAi agent
  modified_base 1-19: /mod_base = "2'-hydroxy corresponding nucleoside"
cccuggugugcuaccaccat

SEQ ID NO: 1440 - DNA, 20 bp, artificial sequence
  sense strand of an RNAi agent
  modified_base 1-19: /mod_base = "2'-hydroxy corresponding nucleoside"
ccuggugugcuaccacccat

SEQ ID NO: 1441 - DNA, 20 bp, artificial sequence
  sense strand of an RNAi agent
  modified_base 1-19: /mod_base = "2'-hydroxy corresponding nucleoside"
cuggugugcuaccaccccat

SEQ ID NO: 1442 - DNA, 20 bp, artificial sequence
  sense strand of an RNAi agent
  modified_base 1-19: /mod_base = "2'-hydroxy corresponding nucleoside"
uuggagcccaagaaagugat

SEQ ID NO: 1443 - DNA, 20 bp, artificial sequence
  sense strand of an RNAi agent
  modified_base 1-19: /mod_base = "2'-hydroxy corresponding nucleoside"
uggagcccaagaaagugaat

SEQ ID NO: 1444 - DNA, 20 bp, artificial sequence
  sense strand of an RNAi agent
  modified_base 1-19: /mod_base = "2'-hydroxy corresponding nucleoside"
ggagcccaagaaagugaaat

SEQ ID NO: 1445 - DNA, 20 bp, artificial sequence
  sense strand of an RNAi agent
  modified_base 1-19: /mod_base = "2'-hydroxy corresponding nucleoside"
gagcccaagaaagugaaaat

SEQ ID NO: 1446 - DNA, 20 bp, artificial sequence
  sense strand of an RNAi agent
  modified_base 1-19: /mod_base = "2'-hydroxy corresponding nucleoside"
gcccaagaaagugaaagaat

SEQ ID NO: 1447 - DNA, 20 bp, artificial sequence
  sense strand of an RNAi agent
  modified_base 1-19: /mod_base = "2'-hydroxy corresponding nucleoside"
gugcuuugagccucagcuat

SEQ ID NO: 1448 - DNA, 20 bp, artificial sequence
  sense strand of an RNAi agent
  modified_base 1-19: /mod_base = "2'-hydroxy corresponding nucleoside"
ugcuuugagccucagcuuat

SEQ ID NO: 1449 - DNA, 20 bp, artificial sequence
  sense strand of an RNAi agent
  modified_base 1-19: /mod_base = "2'-hydroxy corresponding nucleoside"
gcuuugagccucagcuucat

SEQ ID NO: 1450 - DNA, 20 bp, artificial sequence
  sense strand of an RNAi agent
  modified_base 1-19: /mod_base = "2'-hydroxy corresponding nucleoside"
cuggccagccaggccugcat

SEQ ID NO: 1451 - DNA, 20 bp, artificial sequence
  sense strand of an RNAi agent
  modified_base 1-19: /mod_base = "2'-hydroxy corresponding nucleoside"
ccaccaguucgagggggcat

SEQ ID NO: 1452 - DNA, 20 bp, artificial sequence
  sense strand of an RNAi agent
  modified_base 1-19: /mod_base = "2'-hydroxy corresponding nucleoside"
gggcuguggugaccgcaaat

SEQ ID NO: 1453 - DNA, 20 bp, artificial sequence
  sense strand of an RNAi agent
  modified_base 1-19: /mod_base = "2'-hydroxy corresponding nucleoside"
ggcuguggugaccgcaacat

SEQ ID NO: 1454 - DNA, 20 bp, artificial sequence
  sense strand of an RNAi agent
  modified_base 1-19: /mod_base = "2'-hydroxy corresponding nucleoside"
gcuguggugaccgcaacaat

SEQ ID NO: 1455 - DNA, 20 bp, artificial sequence
  sense strand of an RNAi agent
  modified_base 1-19: /mod_base = "2'-hydroxy corresponding nucleoside"
cuguggugaccgcaacaaat

SEQ ID NO: 1456 - DNA, 20 bp, artificial sequence
  sense strand of an RNAi agent
  modified_base 1-19: /mod_base = "2'-hydroxy corresponding nucleoside"
uguggugaccgcaacaagat

SEQ ID NO: 1457 - DNA, 20 bp, artificial sequence
  sense strand of an RNAi agent
  modified_base 1-19: /mod_base = "2'-hydroxy corresponding nucleoside"
guggugaccgcaacaagcat

SEQ ID NO: 1458 - DNA, 20 bp, artificial sequence
  sense strand of an RNAi agent
  modified_base 1-19: /mod_base = "2'-hydroxy corresponding nucleoside"
uggugaccgcaacaagccat

SEQ ID NO: 1459 - DNA, 20 bp, artificial sequence
  sense strand of an RNAi agent
  modified_base 1-19: /mod_base = "2'-hydroxy corresponding nucleoside"
gaacucaauaaagugcuuat

SEQ ID NO: 1460 - DNA, 20 bp, artificial sequence
  sense strand of an RNAi agent
  modified_base 1-19: /mod_base = "2'-hydroxy corresponding nucleoside"
cucaauaaagugcuuugaat

SEQ ID NO: 1461 - DNA, 20 bp, artificial sequence
  sense strand of an RNAi agent
  modified_base 1-19: /mod_base = "2'-hydroxy corresponding nucleoside"
ucaauaaagugcuuugaaat

SEQ ID NO: 1462 - DNA, 20 bp, artificial sequence
  sense strand of an RNAi agent
  modified_base 1-19: /mod_base = "2'-hydroxy corresponding nucleoside"
caauaaagugcuuugaaaat

SEQ ID NO: 1463 - DNA, 21 bp, artificial sequence
  antisense strand of an RNAi agent
  modified_base 2-19: /mod_base = "2'-hydroxy corresponding nucleoside"
tggugguagcacaccagggtt

SEQ ID NO: 1464 - DNA, 21 bp, artificial sequence
  antisense strand of an RNAi agent
  modified_base 2-19: /mod_base = "2'-hydroxy corresponding nucleoside"
tgggugguagcacaccaggtt

SEQ ID NO: 1465 - DNA, 21 bp, artificial sequence
  antisense strand of an RNAi agent
  modified_base 2-19: /mod_base = "2'-hydroxy corresponding nucleoside"
tggggugguagcacaccagtt

SEQ ID NO: 1466 - DNA, 21 bp, artificial sequence
  antisense strand of an RNAi agent
  modified_base 2-19: /mod_base = "2'-hydroxy corresponding nucleoside"
tcacuuucuugggcuccaatt

SEQ ID NO: 1467 - DNA, 21 bp, artificial sequence
  antisense strand of an RNAi agent
  modified_base 2-19: /mod_base = "2'-hydroxy corresponding nucleoside"
tucacuuucuugggcuccatt

SEQ ID NO: 1468 - DNA, 21 bp, artificial sequence
  antisense strand of an RNAi agent
  modified_base 2-19: /mod_base = "2'-hydroxy corresponding nucleoside"
tuucacuuucuugggcucctt

SEQ ID NO: 1469 - DNA, 21 bp, artificial sequence
  antisense strand of an RNAi agent
  modified_base 2-19: /mod_base = "2'-hydroxy corresponding nucleoside"
tuuucacuuucuugggcuctt

SEQ ID NO: 1470 - DNA, 21 bp, artificial sequence
  antisense strand of an RNAi agent
  modified_base 2-19: /mod_base = "2'-hydroxy corresponding nucleoside"
tagcugaggcucaaagcactt

SEQ ID NO: 1471 - DNA, 21 bp, artificial sequence
  antisense strand of an RNAi agent
  modified_base 2-19: /mod_base = "2'-hydroxy corresponding nucleoside"
taagcugaggcucaaagcatt

SEQ ID NO: 1472 - DNA, 21 bp, artificial sequence
  antisense strand of an RNAi agent
  modified_base 2-19: /mod_base = "2'-hydroxy corresponding nucleoside"
tgaagcugaggcucaaagctt

SEQ ID NO: 1473 - DNA, 21 bp, artificial sequence
  antisense strand of an RNAi agent
  modified_base 2-19: /mod_base = "2'-hydroxy corresponding nucleoside"
tgcaggccuggcuggccagtt

SEQ ID NO: 1474 - DNA, 21 bp, artificial sequence
  antisense strand of an RNAi agent
  modified_base 2-19: /mod_base = "2'-hydroxy corresponding nucleoside"
tgcccccucgaacugguggtt

SEQ ID NO: 1475 - DNA, 21 bp, artificial sequence
  antisense strand of an RNAi agent
  modified_base 2-19: /mod_base = "2'-hydroxy corresponding nucleoside"
tuugcggucaccacagccctt

SEQ ID NO: 1476 - DNA, 21 bp, artificial sequence
  antisense strand of an RNAi agent
  modified_base 2-19: /mod_base = "2'-hydroxy corresponding nucleoside"
tguugcggucaccacagcctt

SEQ ID NO: 1477 - DNA, 21 bp, artificial sequence
  antisense strand of an RNAi agent
  modified_base 2-19: /mod_base = "2'-hydroxy corresponding nucleoside"
tuguugcggucaccacagctt

SEQ ID NO: 1478 - DNA, 21 bp, artificial sequence
  antisense strand of an RNAi agent
  modified_base 2-19: /mod_base = "2'-hydroxy corresponding nucleoside"
tuuguugcggucaccacagtt

SEQ ID NO: 1479 - DNA, 21 bp, artificial sequence
  antisense strand of an RNAi agent
  modified_base 2-19: /mod_base = "2'-hydroxy corresponding nucleoside"
tcuuguugcggucaccacatt

SEQ ID NO: 1480 - DNA, 21 bp, artificial sequence
  antisense strand of an RNAi agent
  modified_base 2-19: /mod_base = "2'-hydroxy corresponding nucleoside"
tgcuuguugcggucaccactt

SEQ ID NO: 1481 - DNA, 21 bp, artificial sequence
  antisense strand of an RNAi agent
  modified_base 2-19: /mod_base = "2'-hydroxy corresponding nucleoside"
tggcuuguugcggucaccatt

SEQ ID NO: 1482 - DNA, 21 bp, artificial sequence
  antisense strand of an RNAi agent
  modified_base 2-19: /mod_base = "2'-hydroxy corresponding nucleoside"
taagcacuuuauugaguuctt

SEQ ID NO: 1483 - DNA, 21 bp, artificial sequence
  antisense strand of an RNAi agent
  modified_base 2-19: /mod_base = "2'-hydroxy corresponding nucleoside"
taaagcacuuuauugaguutt

SEQ ID NO: 1484 - DNA, 21 bp, artificial sequence
  antisense strand of an RNAi agent
  modified_base 2-19: /mod_base = "2'-hydroxy corresponding nucleoside"
tcaaagcacuuuauugagutt

SEQ ID NO: 1485 - DNA, 21 bp, artificial sequence
  antisense strand of an RNAi agent
  modified_base 2-19: /mod_base = "2'-hydroxy corresponding nucleoside"
tucaaagcacuuuauugagtt

SEQ ID NO: 1486 - DNA, 21 bp, artificial sequence
  antisense strand of an RNAi agent
  modified_base 2-19: /mod_base = "2'-hydroxy corresponding nucleoside"
tuucaaagcacuuuauugatt

SEQ ID NO: 1487 - DNA, 21 bp, artificial sequence
  antisense strand of an RNAi agent
  modified_base 2-19: /mod_base = "2'-hydroxy corresponding nucleoside"
tuuucaaagcacuuuauugtt

SEQ ID NO: 1488 - DNA, 21 bp, artificial sequence
  antisense strand of an RNAi agent
  modified_base 2-19: /mod_base = "2'-hydroxy corresponding nucleoside"
tuuuucaaagcacuuuauutt

SEQ ID NO: 1489 - RNA, 19 nt, artificial sequence
  sense strand of an RNAi agent
uggagucaacacuuucgau

SEQ ID NO: 1490 - RNA, 19 nt, artificial sequence
  sense strand of an RNAi agent
ggagucaacacuuucgauu

SEQ ID NO: 1491 - RNA, 19 nt, artificial sequence
  sense strand of an RNAi agent
cccaaggagcauaaguaca

SEQ ID NO: 1492 - RNA, 19 nt, artificial sequence
  sense strand of an RNAi agent
ccaaggagcauaaguacaa

SEQ ID NO: 1493 - RNA, 19 nt, artificial sequence
  sense strand of an RNAi agent
caaggagcauaaguacaaa

SEQ ID NO: 1494 - RNA, 19 nt, artificial sequence
  sense strand of an RNAi agent
agcauaaguacaaagcuga

SEQ ID NO: 1495 - RNA, 19 nt, artificial sequence
  sense strand of an RNAi agent
ugaagagcacacagucguu

SEQ ID NO: 1496 - RNA, 19 nt, artificial sequence
  sense strand of an RNAi agent
gaagagcacacagucguuc

SEQ ID NO: 1497 - RNA, 19 nt, artificial sequence
  sense strand of an RNAi agent
aagagcacacagucguucu

SEQ ID NO: 1498 - RNA, 19 nt, artificial sequence
  sense strand of an RNAi agent
cacagucguucucacuguc

SEQ ID NO: 1499 - RNA, 19 nt, artificial sequence
  sense strand of an RNAi agent
cagucguucucacugucac

SEQ ID NO: 1500 - RNA, 19 nt, artificial sequence
  sense strand of an RNAi agent
gcuguaccacaaauguacc

SEQ ID NO: 1501 - RNA, 19 nt, artificial sequence
  sense strand of an RNAi agent
cuguaccacaaauguaccc

SEQ ID NO: 1502 - RNA, 19 nt, artificial sequence
  sense strand of an RNAi agent
uguaccacaaauguaccca

SEQ ID NO: 1503 - RNA, 19 nt, artificial sequence
  sense strand of an RNAi agent
ccacaaauguacccacaag

SEQ ID NO: 1504 - RNA, 19 nt, artificial sequence
  sense strand of an RNAi agent
agaugccagugcaaggguc

SEQ ID NO: 1505 - RNA, 19 nt, artificial sequence
  sense strand of an RNAi agent
ggggucgcugccuagaggu

SEQ ID NO: 1506 - RNA, 19 nt, artificial sequence
  sense strand of an RNAi agent
gcugcuaugauggccgcgg

SEQ ID NO: 1507 - RNA, 19 nt, artificial sequence
  sense strand of an RNAi agent
cugcuaugauggccgcggg

SEQ ID NO: 1508 - RNA, 19 nt, artificial sequence
  sense strand of an RNAi agent
uggccgcgggcucagcuac

SEQ ID NO: 1509 - RNA, 19 nt, artificial sequence
  sense strand of an RNAi agent
ccgcgggcucagcuaccgc

SEQ ID NO: 1510 - RNA, 19 nt, artificial sequence
  sense strand of an RNAi agent
gaccacgcucucgggugcg

SEQ ID NO: 1511 - RNA, 19 nt, artificial sequence
  sense strand of an RNAi agent
accacgcucucgggugcgc

SEQ ID NO: 1512 - RNA, 19 nt, artificial sequence
  sense strand of an RNAi agent
ccacgcucucgggugcgcc

SEQ ID NO: 1513 - RNA, 19 nt, artificial sequence
  sense strand of an RNAi agent
aagcgcggaacuggggacu

SEQ ID NO: 1514 - RNA, 19 nt, artificial sequence
  sense strand of an RNAi agent
ggacugggcggccacgccu

SEQ ID NO: 1515 - RNA, 19 nt, artificial sequence
  sense strand of an RNAi agent
gccggaacccggacaacga

SEQ ID NO: 1516 - RNA, 19 nt, artificial sequence
  sense strand of an RNAi agent
cggaacccggacaacgaca

SEQ ID NO: 1517 - RNA, 19 nt, artificial sequence
  sense strand of an RNAi agent
ggaacccggacaacgacau

SEQ ID NO: 1518 - RNA, 19 nt, artificial sequence
  sense strand of an RNAi agent
gaacccggacaacgacauc

SEQ ID NO: 1519 - RNA, 19 nt, artificial sequence
  sense strand of an RNAi agent
ccggacaacgacauccgcc

SEQ ID NO: 1520 - RNA, 19 nt, artificial sequence
  sense strand of an RNAi agent
acaacgacauccgcccgug

SEQ ID NO: 1521 - RNA, 19 nt, artificial sequence
  sense strand of an RNAi agent
caacgacauccgcccgugg

SEQ ID NO: 1522 - RNA, 19 nt, artificial sequence
  sense strand of an RNAi agent
aacgacauccgcccguggu

SEQ ID NO: 1523 - RNA, 19 nt, artificial sequence
  sense strand of an RNAi agent
acgacauccgcccguggug

SEQ ID NO: 1524 - RNA, 19 nt, artificial sequence
  sense strand of an RNAi agent
cauccgcccguggugcuuc

SEQ ID NO: 1525 - RNA, 19 nt, artificial sequence
  sense strand of an RNAi agent
auccgcccguggugcuucg

SEQ ID NO: 1526 - RNA, 19 nt, artificial sequence
  sense strand of an RNAi agent
ccgcccguggugcuucgug

SEQ ID NO: 1527 - RNA, 19 nt, artificial sequence
  sense strand of an RNAi agent
gcccguggugcuucgugcu

SEQ ID NO: 1528 - RNA, 19 nt, artificial sequence
  sense strand of an RNAi agent
cuucaugucccacucaugc

SEQ ID NO: 1529 - RNA, 19 nt, artificial sequence
  sense strand of an RNAi agent
gcagccggcaccgccgaag

SEQ ID NO: 1530 - RNA, 19 nt, artificial sequence
  sense strand of an RNAi agent
ggcuccgcaagagucuguc

SEQ ID NO: 1531 - RNA, 19 nt, artificial sequence
  sense strand of an RNAi agent
gcuccgcaagagucugucu

SEQ ID NO: 1532 - RNA, 19 nt, artificial sequence
  sense strand of an RNAi agent
gagucugucuucgaugacc

SEQ ID NO: 1533 - RNA, 19 nt, artificial sequence
  sense strand of an RNAi agent
agucugucuucgaugaccc

SEQ ID NO: 1534 - RNA, 19 nt, artificial sequence
  sense strand of an RNAi agent
gucuucgaugacccgcguc

SEQ ID NO: 1535 - RNA, 19 nt, artificial sequence
  sense strand of an RNAi agent
ucuucgaugacccgcgucg

SEQ ID NO: 1536 - RNA, 19 nt, artificial sequence
  sense strand of an RNAi agent
cuucgaugacccgcgucgu

SEQ ID NO: 1537 - RNA, 19 nt, artificial sequence
  sense strand of an RNAi agent
uucgaugacccgcgucguu

SEQ ID NO: 1538 - RNA, 19 nt, artificial sequence
  sense strand of an RNAi agent
ucgaugacccgcgucguug

SEQ ID NO: 1539 - RNA, 19 nt, artificial sequence
  sense strand of an RNAi agent
cgaugacccgcgucguugg

SEQ ID NO: 1540 - RNA, 19 nt, artificial sequence
  sense strand of an RNAi agent
gaugacccgcgucguuggc

SEQ ID NO: 1541 - RNA, 19 nt, artificial sequence
  sense strand of an RNAi agent
ugacccgcgucguuggcgg

SEQ ID NO: 1542 - RNA, 19 nt, artificial sequence
  sense strand of an RNAi agent
gacccgcgucguuggcggg

SEQ ID NO: 1543 - RNA, 19 nt, artificial sequence
  sense strand of an RNAi agent
gcugguggcgcuacgcggg

SEQ ID NO: 1544 - RNA, 19 nt, artificial sequence
  sense strand of an RNAi agent
ugguggcgcuacgcggggc

SEQ ID NO: 1545 - RNA, 19 nt, artificial sequence
  sense strand of an RNAi agent
gguggcgcuacgcggggcg

SEQ ID NO: 1546 - RNA, 19 nt, artificial sequence
  sense strand of an RNAi agent
guggcgcuacgcggggcgc

SEQ ID NO: 1547 - RNA, 19 nt, artificial sequence
  sense strand of an RNAi agent
gcuacgcggggcgcacccc

SEQ ID NO: 1548 - RNA, 19 nt, artificial sequence
  sense strand of an RNAi agent
ggcgcaccccuacaucgcc

SEQ ID NO: 1549 - RNA, 19 nt, artificial sequence
  sense strand of an RNAi agent
caccccuacaucgccgcgc

SEQ ID NO: 1550 - RNA, 19 nt, artificial sequence
  sense strand of an RNAi agent
ccccuacaucgccgcgcug

SEQ ID NO: 1551 - RNA, 19 nt, artificial sequence
  sense strand of an RNAi agent
cccuacaucgccgcgcugu

SEQ ID NO: 1552 - RNA, 19 nt, artificial sequence
  sense strand of an RNAi agent
ccuacaucgccgcgcugua

SEQ ID NO: 1553 - RNA, 19 nt, artificial sequence
  sense strand of an RNAi agent
cuacaucgccgcgcuguac

SEQ ID NO: 1554 - RNA, 19 nt, artificial sequence
  sense strand of an RNAi agent
uacaucgccgcgcuguacu

SEQ ID NO: 1555 - RNA, 19 nt, artificial sequence
  sense strand of an RNAi agent
caucgccgcgcuguacugg

SEQ ID NO: 1556 - RNA, 19 nt, artificial sequence
  sense strand of an RNAi agent
ucgccgcgcuguacugggg

SEQ ID NO: 1557 - RNA, 19 nt, artificial sequence
  sense strand of an RNAi agent
cugcgccggcagccucauc

SEQ ID NO: 1558 - RNA, 19 nt, artificial sequence
  sense strand of an RNAi agent
gcacccgaggaucugacgg

SEQ ID NO: 1559 - RNA, 19 nt, artificial sequence
  sense strand of an RNAi agent
cacccgaggaucugacggu

SEQ ID NO: 1560 - RNA, 19 nt, artificial sequence
  sense strand of an RNAi agent
uugcacgaggccuucucgc

SEQ ID NO: 1561 - RNA, 19 nt, artificial sequence
  sense strand of an RNAi agent
ugcacgaggccuucucgcc

SEQ ID NO: 1562 - RNA, 19 nt, artificial sequence
  sense strand of an RNAi agent
gcacgaccuggcucuguug

SEQ ID NO: 1563 - RNA, 19 nt, artificial sequence
  sense strand of an RNAi agent
gcucuguugcgccuucagg

SEQ ID NO: 1564 - RNA, 19 nt, artificial sequence
  sense strand of an RNAi agent
uugcgccuucaggaggaug

SEQ ID NO: 1565 - RNA, 19 nt, artificial sequence
  sense strand of an RNAi agent
ggacggcagcugcgcgcuc

SEQ ID NO: 1566 - RNA, 19 nt, artificial sequence
  sense strand of an RNAi agent
cgcgcuccugucgccuuac

SEQ ID NO: 1567 - RNA, 19 nt, artificial sequence
  sense strand of an RNAi agent
gcgcuccugucgccuuacg

SEQ ID NO: 1568 - RNA, 19 nt, artificial sequence
  sense strand of an RNAi agent
cgcuccugucgccuuacgu

SEQ ID NO: 1569 - RNA, 19 nt, artificial sequence
  sense strand of an RNAi agent
gcuccugucgccuuacguu

SEQ ID NO: 1570 - RNA, 19 nt, artificial sequence
  sense strand of an RNAi agent
cuccugucgccuuacguuc

SEQ ID NO: 1571 - RNA, 19 nt, artificial sequence
  sense strand of an RNAi agent
uccugucgccuuacguuca

SEQ ID NO: 1572 - RNA, 19 nt, artificial sequence
  sense strand of an RNAi agent
ugucgccuuacguucagcc

SEQ ID NO: 1573 - RNA, 19 nt, artificial sequence
  sense strand of an RNAi agent
gucgccuuacguucagccg

SEQ ID NO: 1574 - RNA, 19 nt, artificial sequence
  sense strand of an RNAi agent
ucgccuuacguucagccgg

SEQ ID NO: 1575 - RNA, 19 nt, artificial sequence
  sense strand of an RNAi agent
cgccuuacguucagccggu

SEQ ID NO: 1576 - RNA, 19 nt, artificial sequence
  sense strand of an RNAi agent
gccuuacguucagccggug

SEQ ID NO: 1577 - RNA, 19 nt, artificial sequence
  sense strand of an RNAi agent
cuuacguucagccggugug

SEQ ID NO: 1578 - RNA, 19 nt, artificial sequence
  sense strand of an RNAi agent
acguucagccggugugccu

SEQ ID NO: 1579 - RNA, 19 nt, artificial sequence
  sense strand of an RNAi agent
ggugugccugccaagcggc

SEQ ID NO: 1580 - RNA, 19 nt, artificial sequence
  sense strand of an RNAi agent
gccaccaguucgagggggc

SEQ ID NO: 1581 - RNA, 19 nt, artificial sequence
  sense strand of an RNAi agent
caccaguucgagggggcgg

SEQ ID NO: 1582 - RNA, 19 nt, artificial sequence
  sense strand of an RNAi agent
ucgagggggcggaggaaua

SEQ ID NO: 1583 - RNA, 19 nt, artificial sequence
  sense strand of an RNAi agent
cugcgcaggguuccucgag

SEQ ID NO: 1584 - RNA, 19 nt, artificial sequence
  sense strand of an RNAi agent
ugcgcaggguuccucgagg

SEQ ID NO: 1585 - RNA, 19 nt, artificial sequence
  sense strand of an RNAi agent
gcgcaggguuccucgaggg

SEQ ID NO: 1586 - RNA, 19 nt, artificial sequence
  sense strand of an RNAi agent
uuccucgagggcggcaccg

SEQ ID NO: 1587 - RNA, 19 nt, artificial sequence
  sense strand of an RNAi agent
cucgagggcggcaccgaug

SEQ ID NO: 1588 - RNA, 19 nt, artificial sequence
  sense strand of an RNAi agent
ucgagggcggcaccgaugc

SEQ ID NO: 1589 - RNA, 19 nt, artificial sequence
  sense strand of an RNAi agent
cagagcgccggcucacccu

SEQ ID NO: 1590 - RNA, 19 nt, artificial sequence
  sense strand of an RNAi agent
aucagcuggggaucgggcu

SEQ ID NO: 1591 - RNA, 19 nt, artificial sequence
  sense strand of an RNAi agent
gaucgggcuguggugaccg

SEQ ID NO: 1592 - RNA, 19 nt, artificial sequence
  sense strand of an RNAi agent
ccgcaacaagccaggcguc

SEQ ID NO: 1593 - RNA, 19 nt, artificial sequence
  sense strand of an RNAi agent
gcaacaagccaggcgucua

SEQ ID NO: 1594 - RNA, 19 nt, artificial sequence
  sense strand of an RNAi agent
aggcgucuacaccgaugug

SEQ ID NO: 1595 - RNA, 19 nt, artificial sequence
  sense strand of an RNAi agent
ggcgucuacaccgaugugg

SEQ ID NO: 1596 - RNA, 19 nt, artificial sequence
  sense strand of an RNAi agent
gcgucuacaccgauguggc

SEQ ID NO: 1597 - RNA, 19 nt, artificial sequence
  sense strand of an RNAi agent
cuggauccgggagcacacc

SEQ ID NO: 1598 - RNA, 19 nt, artificial sequence
  sense strand of an RNAi agent
cugauugcucagggacuca

SEQ ID NO: 1599 - RNA, 19 nt, artificial sequence
  sense strand of an RNAi agent
auugcucagggacucaucu

SEQ ID NO: 1600 - RNA, 19 nt, artificial sequence
  sense strand of an RNAi agent
aggaacucaauaaagugcu

SEQ ID NO: 1601 - RNA, 19 nt, artificial sequence
  sense strand of an RNAi agent
ggaacucaauaaagugcuu

SEQ ID NO: 1602 - RNA, 19 nt, artificial sequence
  antisense strand of an RNAi agent
aucgaaaguguugacucca

SEQ ID NO: 1603 - RNA, 19 nt, artificial sequence
  antisense strand of an RNAi agent
aaucgaaaguguugacucc

SEQ ID NO: 1604 - RNA, 19 nt, artificial sequence
  antisense strand of an RNAi agent
uguacuuaugcuccuuggg

SEQ ID NO: 1605 - RNA, 19 nt, artificial sequence
  antisense strand of an RNAi agent
uuguacuuaugcuccuugg

SEQ ID NO: 1606 - RNA, 19 nt, artificial sequence
  antisense strand of an RNAi agent
uuuguacuuaugcuccuug

SEQ ID NO: 1607 - RNA, 19 nt, artificial sequence
  antisense strand of an RNAi agent
ucagcuuuguacuuaugcu

SEQ ID NO: 1608 - RNA, 19 nt, artificial sequence
  antisense strand of an RNAi agent
aacgacugugugcucuuca

SEQ ID NO: 1609 - RNA, 19 nt, artificial sequence
  antisense strand of an RNAi agent
gaacgacugugugcucuuc

SEQ ID NO: 1610 - RNA, 19 nt, artificial sequence
  antisense strand of an RNAi agent
agaacgacugugugcucuu

SEQ ID NO: 1611 - RNA, 19 nt, artificial sequence
  antisense strand of an RNAi agent
gacagugagaacgacugug

SEQ ID NO: 1612 - RNA, 19 nt, artificial sequence
  antisense strand of an RNAi agent
gugacagugagaacgacug

SEQ ID NO: 1613 - RNA, 19 nt, artificial sequence
  antisense strand of an RNAi agent
gguacauuugugguacagc

SEQ ID NO: 1614 - RNA, 19 nt, artificial sequence
  antisense strand of an RNAi agent
ggguacauuugugguacag

SEQ ID NO: 1615 - RNA, 19 nt, artificial sequence
  antisense strand of an RNAi agent
uggguacauuugugguaca

SEQ ID NO: 1616 - RNA, 19 nt, artificial sequence
  antisense strand of an RNAi agent
cuuguggguacauuugugg

SEQ ID NO: 1617 - RNA, 19 nt, artificial sequence
  antisense strand of an RNAi agent
gacccuugcacuggcaucu

SEQ ID NO: 1618 - RNA, 19 nt, artificial sequence
  antisense strand of an RNAi agent
accucuaggcagcgacccc

SEQ ID NO: 1619 - RNA, 19 nt, artificial sequence
  antisense strand of an RNAi agent
ccgcggccaucauagcagc

SEQ ID NO: 1620 - RNA, 19 nt, artificial sequence
  antisense strand of an RNAi agent
cccgcggccaucauagcag

SEQ ID NO: 1621 - RNA, 19 nt, artificial sequence
  antisense strand of an RNAi agent
guagcugagcccgcggcca

SEQ ID NO: 1622 - RNA, 19 nt, artificial sequence
  antisense strand of an RNAi agent
gcgguagcugagcccgcgg

SEQ ID NO: 1623 - RNA, 19 nt, artificial sequence
  antisense strand of an RNAi agent
cgcacccgagagcgugguc

SEQ ID NO: 1624 - RNA, 19 nt, artificial sequence
  antisense strand of an RNAi agent
gcgcacccgagagcguggu

SEQ ID NO: 1625 - RNA, 19 nt, artificial sequence
  antisense strand of an RNAi agent
ggcgcacccgagagcgugg

SEQ ID NO: 1626 - RNA, 19 nt, artificial sequence
  antisense strand of an RNAi agent
aguccccaguuccgcgcuu

SEQ ID NO: 1627 - RNA, 19 nt, artificial sequence
  antisense strand of an RNAi agent
aggcguggccgcccagucc

SEQ ID NO: 1628 - RNA, 19 nt, artificial sequence
  antisense strand of an RNAi agent
ucguuguccggguuccggc

SEQ ID NO: 1629 - RNA, 19 nt, artificial sequence
  antisense strand of an RNAi agent
ugucguuguccggguuccg

SEQ ID NO: 1630 - RNA, 19 nt, artificial sequence
  antisense strand of an RNAi agent
augucguuguccggguucc

SEQ ID NO: 1631 - RNA, 19 nt, artificial sequence
  antisense strand of an RNAi agent
gaugucguuguccggguuc

SEQ ID NO: 1632 - RNA, 19 nt, artificial sequence
  antisense strand of an RNAi agent
ggcggaugucguuguccgg

SEQ ID NO: 1633 - RNA, 19 nt, artificial sequence
  antisense strand of an RNAi agent
cacgggcggaugucguugu

SEQ ID NO: 1634 - RNA, 19 nt, artificial sequence
  antisense strand of an RNAi agent
ccacgggcggaugucguug

SEQ ID NO: 1635 - RNA, 19 nt, artificial sequence
  antisense strand of an RNAi agent
accacgggcggaugucguu

SEQ ID NO: 1636 - RNA, 19 nt, artificial sequence
  antisense strand of an RNAi agent
caccacgggcggaugucgu

SEQ ID NO: 1637 - RNA, 19 nt, artificial sequence
  antisense strand of an RNAi agent
gaagcaccacgggcggaug

SEQ ID NO: 1638 - RNA, 19 nt, artificial sequence
  antisense strand of an RNAi agent
cgaagcaccacgggcggau

SEQ ID NO: 1639 - RNA, 19 nt, artificial sequence
  antisense strand of an RNAi agent
cacgaagcaccacgggcgg

SEQ ID NO: 1640 - RNA, 19 nt, artificial sequence
  antisense strand of an RNAi agent
agcacgaagcaccacgggc

SEQ ID NO: 1641 - RNA, 19 nt, artificial sequence
  antisense strand of an RNAi agent
gcaugagugggacaugaag

SEQ ID NO: 1642 - RNA, 19 nt, artificial sequence
  antisense strand of an RNAi agent
cuucggcggugccggcugc

SEQ ID NO: 1643 - RNA, 19 nt, artificial sequence
  antisense strand of an RNAi agent
gacagacucuugcggagcc

SEQ ID NO: 1644 - RNA, 19 nt, artificial sequence
  antisense strand of an RNAi agent
agacagacucuugcggagc

SEQ ID NO: 1645 - RNA, 19 nt, artificial sequence
  antisense strand of an RNAi agent
ggucaucgaagacagacuc

SEQ ID NO: 1646 - RNA, 19 nt, artificial sequence
  antisense strand of an RNAi agent
gggucaucgaagacagacu

SEQ ID NO: 1647 - RNA, 19 nt, artificial sequence
  antisense strand of an RNAi agent
gacgcgggucaucgaagac

SEQ ID NO: 1648 - RNA, 19 nt, artificial sequence
  antisense strand of an RNAi agent
cgacgcgggucaucgaaga

SEQ ID NO: 1649 - RNA, 19 nt, artificial sequence
  antisense strand of an RNAi agent
acgacgcgggucaucgaag

SEQ ID NO: 1650 - RNA, 19 nt, artificial sequence
  antisense strand of an RNAi agent
aacgacgcgggucaucgaa

SEQ ID NO: 1651 - RNA, 19 nt, artificial sequence
  antisense strand of an RNAi agent
caacgacgcgggucaucga

SEQ ID NO: 1652 - RNA, 19 nt, artificial sequence
  antisense strand of an RNAi agent
ccaacgacgcgggucaucg

SEQ ID NO: 1653 - RNA, 19 nt, artificial sequence
  antisense strand of an RNAi agent
gccaacgacgcgggucauc

SEQ ID NO: 1654 - RNA, 19 nt, artificial sequence
  antisense strand of an RNAi agent
ccgccaacgacgcggguca

SEQ ID NO: 1655 - RNA, 19 nt, artificial sequence
  antisense strand of an RNAi agent
cccgccaacgacgcggguc

SEQ ID NO: 1656 - RNA, 19 nt, artificial sequence
  antisense strand of an RNAi agent
cccgcguagcgccaccagc

SEQ ID NO: 1657 - RNA, 19 nt, artificial sequence
  antisense strand of an RNAi agent
gccccgcguagcgccacca

SEQ ID NO: 1658 - RNA, 19 nt, artificial sequence
  antisense strand of an RNAi agent
cgccccgcguagcgccacc

SEQ ID NO: 1659 - RNA, 19 nt, artificial sequence
  antisense strand of an RNAi agent
gcgccccgcguagcgccac

SEQ ID NO: 1660 - RNA, 19 nt, artificial sequence
  antisense strand of an RNAi agent
ggggugcgccccgcguagc

SEQ ID NO: 1661 - RNA, 19 nt, artificial sequence
  antisense strand of an RNAi agent
ggcgauguaggggugcgcc

SEQ ID NO: 1662 - RNA, 19 nt, artificial sequence
  antisense strand of an RNAi agent
gcgcggcgauguaggggug

SEQ ID NO: 1663 - RNA, 19 nt, artificial sequence
  antisense strand of an RNAi agent
cagcgcggcgauguagggg

SEQ ID NO: 1664 - RNA, 19 nt, artificial sequence
  antisense strand of an RNAi agent
acagcgcggcgauguaggg

SEQ ID NO: 1665 - RNA, 19 nt, artificial sequence
  antisense strand of an RNAi agent
uacagcgcggcgauguagg

SEQ ID NO: 1666 - RNA, 19 nt, artificial sequence
  antisense strand of an RNAi agent
guacagcgcggcgauguag

SEQ ID NO: 1667 - RNA, 19 nt, artificial sequence
  antisense strand of an RNAi agent
aguacagcgcggcgaugua

SEQ ID NO: 1668 - RNA, 19 nt, artificial sequence
  antisense strand of an RNAi agent
ccaguacagcgcggcgaug

SEQ ID NO: 1669 - RNA, 19 nt, artificial sequence
  antisense strand of an RNAi agent
ccccaguacagcgcggcga

SEQ ID NO: 1670 - RNA, 19 nt, artificial sequence
  antisense strand of an RNAi agent
gaugaggcugccggcgcag

SEQ ID NO: 1671 - RNA, 19 nt, artificial sequence
  antisense strand of an RNAi agent
ccgucagauccucgggugc

SEQ ID NO: 1672 - RNA, 19 nt, artificial sequence
  antisense strand of an RNAi agent
accgucagauccucgggug

SEQ ID NO: 1673 - RNA, 19 nt, artificial sequence
  antisense strand of an RNAi agent
gcgagaaggccucgugcaa

SEQ ID NO: 1674 - RNA, 19 nt, artificial sequence
  antisense strand of an RNAi agent
ggcgagaaggccucgugca

SEQ ID NO: 1675 - RNA, 19 nt, artificial sequence
  antisense strand of an RNAi agent
caacagagccaggucgugc

SEQ ID NO: 1676 - RNA, 19 nt, artificial sequence
  antisense strand of an RNAi agent
ccugaaggcgcaacagagc

SEQ ID NO: 1677 - RNA, 19 nt, artificial sequence
  antisense strand of an RNAi agent
cauccuccugaaggcgcaa

SEQ ID NO: 1678 - RNA, 19 nt, artificial sequence
  antisense strand of an RNAi agent
gagcgcgcagcugccgucc

SEQ ID NO: 1679 - RNA, 19 nt, artificial sequence
  antisense strand of an RNAi agent
guaaggcgacaggagcgcg

SEQ ID NO: 1680 - RNA, 19 nt, artificial sequence
  antisense strand of an RNAi agent
cguaaggcgacaggagcgc

SEQ ID NO: 1681 - RNA, 19 nt, artificial sequence
  antisense strand of an RNAi agent
acguaaggcgacaggagcg

SEQ ID NO: 1682 - RNA, 19 nt, artificial sequence
  antisense strand of an RNAi agent
aacguaaggcgacaggagc

SEQ ID NO: 1683 - RNA, 19 nt, artificial sequence
  antisense strand of an RNAi agent
gaacguaaggcgacaggag

SEQ ID NO: 1684 - RNA, 19 nt, artificial sequence
  antisense strand of an RNAi agent
ugaacguaaggcgacagga

SEQ ID NO: 1685 - RNA, 19 nt, artificial sequence
  antisense strand of an RNAi agent
ggcugaacguaaggcgaca

SEQ ID NO: 1686 - RNA, 19 nt, artificial sequence
  antisense strand of an RNAi agent
cggcugaacguaaggcgac

SEQ ID NO: 1687 - RNA, 19 nt, artificial sequence
  antisense strand of an RNAi agent
ccggcugaacguaaggcga

SEQ ID NO: 1688 - RNA, 19 nt, artificial sequence
  antisense strand of an RNAi agent
accggcugaacguaaggcg

SEQ ID NO: 1689 - RNA, 19 nt, artificial sequence
  antisense strand of an RNAi agent
caccggcugaacguaaggc

SEQ ID NO: 1690 - RNA, 19 nt, artificial sequence
  antisense strand of an RNAi agent
cacaccggcugaacguaag

SEQ ID NO: 1691 - RNA, 19 nt, artificial sequence
  antisense strand of an RNAi agent
aggcacaccggcugaacgu

SEQ ID NO: 1692 - RNA, 19 nt, artificial sequence
  antisense strand of an RNAi agent
gccgcuuggcaggcacacc

SEQ ID NO: 1693 - RNA, 19 nt, artificial sequence
  antisense strand of an RNAi agent
gcccccucgaacugguggc

SEQ ID NO: 1694 - RNA, 19 nt, artificial sequence
  antisense strand of an RNAi agent
ccgcccccucgaacuggug

SEQ ID NO: 1695 - RNA, 19 nt, artificial sequence
  antisense strand of an RNAi agent
uauuccuccgcccccucga

SEQ ID NO: 1696 - RNA, 19 nt, artificial sequence
  antisense strand of an RNAi agent
cucgaggaacccugcgcag

SEQ ID NO: 1697 - RNA, 19 nt, artificial sequence
  antisense strand of an RNAi agent
ccucgaggaacccugcgca

SEQ ID NO: 1698 - RNA, 19 nt, artificial sequence
  antisense strand of an RNAi agent
cccucgaggaacccugcgc

SEQ ID NO: 1699 - RNA, 19 nt, artificial sequence
  antisense strand of an RNAi agent
cggugccgcccucgaggaa

SEQ ID NO: 1700 - RNA, 19 nt, artificial sequence
  antisense strand of an RNAi agent
caucggugccgcccucgag

SEQ ID NO: 1701 - RNA, 19 nt, artificial sequence
  antisense strand of an RNAi agent
gcaucggugccgcccucga

SEQ ID NO: 1702 - RNA, 19 nt, artificial sequence
  antisense strand of an RNAi agent
agggugagccggcgcucug

SEQ ID NO: 1703 - RNA, 19 nt, artificial sequence
  antisense strand of an RNAi agent
agcccgauccccagcugau

SEQ ID NO: 1704 - RNA, 19 nt, artificial sequence
  antisense strand of an RNAi agent
cggucaccacagcccgauc

SEQ ID NO: 1705 - RNA, 19 nt, artificial sequence
  antisense strand of an RNAi agent
gacgccuggcuuguugcgg

SEQ ID NO: 1706 - RNA, 19 nt, artificial sequence
  antisense strand of an RNAi agent
uagacgccuggcuuguugc

SEQ ID NO: 1707 - RNA, 19 nt, artificial sequence
  antisense strand of an RNAi agent
cacaucgguguagacgccu

SEQ ID NO: 1708 - RNA, 19 nt, artificial sequence
  antisense strand of an RNAi agent
ccacaucgguguagacgcc

SEQ ID NO: 1709 - RNA, 19 nt, artificial sequence
  antisense strand of an RNAi agent
gccacaucgguguagacgc

SEQ ID NO: 1710 - RNA, 19 nt, artificial sequence
  antisense strand of an RNAi agent
ggugugcucccggauccag

SEQ ID NO: 1711 - RNA, 19 nt, artificial sequence
  antisense strand of an RNAi agent
ugagucccugagcaaucag

SEQ ID NO: 1712 - RNA, 19 nt, artificial sequence
  antisense strand of an RNAi agent
agaugagucccugagcaau

SEQ ID NO: 1713 - RNA, 19 nt, artificial sequence
  antisense strand of an RNAi agent
agcacuuuauugaguuccu

SEQ ID NO: 1714 - RNA, 19 nt, artificial sequence
  antisense strand of an RNAi agent
aagcacuuuauugaguucc

SEQ ID NO: 1715 - DNA, 20 bp, artificial sequence
  sense strand of an RNAi agent
  modified_base 1-19: /mod_base = "2'-hydroxy corresponding nucleoside"
uggagucaacacuuucgaat

SEQ ID NO: 1716 - DNA, 20 bp, artificial sequence
  sense strand of an RNAi agent
  modified_base 1-19: /mod_base = "2'-hydroxy corresponding nucleoside"
ggagucaacacuuucgauat

SEQ ID NO: 1717 - DNA, 20 bp, artificial sequence
  sense strand of an RNAi agent
  modified_base 1-19: /mod_base = "2'-hydroxy corresponding nucleoside"
cccaaggagcauaaguacat

SEQ ID NO: 1718 - DNA, 20 bp, artificial sequence
  sense strand of an RNAi agent
  modified_base 1-19: /mod_base = "2'-hydroxy corresponding nucleoside"
ccaaggagcauaaguacaat

SEQ ID NO: 1719 - DNA, 20 bp, artificial sequence
  sense strand of an RNAi agent
  modified_base 1-19: /mod_base = "2'-hydroxy corresponding nucleoside"
caaggagcauaaguacaaat

SEQ ID NO: 1720 - DNA, 20 bp, artificial sequence
  sense strand of an RNAi agent
  modified_base 1-19: /mod_base = "2'-hydroxy corresponding nucleoside"
agcauaaguacaaagcugat

SEQ ID NO: 1721 - DNA, 20 bp, artificial sequence
  sense strand of an RNAi agent
  modified_base 1-19: /mod_base = "2'-hydroxy corresponding nucleoside"
ugaagagcacacagucguat

SEQ ID NO: 1722 - DNA, 20 bp, artificial sequence
  sense strand of an RNAi agent
  modified_base 1-19: /mod_base = "2'-hydroxy corresponding nucleoside"
gaagagcacacagucguuat

SEQ ID NO: 1723 - DNA, 20 bp, artificial sequence
  sense strand of an RNAi agent
  modified_base 1-19: /mod_base = "2'-hydroxy corresponding nucleoside"
aagagcacacagucguucat

SEQ ID NO: 1724 - DNA, 20 bp, artificial sequence
  sense strand of an RNAi agent
  modified_base 1-19: /mod_base = "2'-hydroxy corresponding nucleoside"
cacagucguucucacuguat

SEQ ID NO: 1725 - DNA, 20 bp, artificial sequence
  sense strand of an RNAi agent
  modified_base 1-19: /mod_base = "2'-hydroxy corresponding nucleoside"
cagucguucucacugucaat

SEQ ID NO: 1726 - DNA, 20 bp, artificial sequence
  sense strand of an RNAi agent
  modified_base 1-19: /mod_base = "2'-hydroxy corresponding nucleoside"
gcuguaccacaaauguacat

SEQ ID NO: 1727 - DNA, 20 bp, artificial sequence
  sense strand of an RNAi agent
  modified_base 1-19: /mod_base = "2'-hydroxy corresponding nucleoside"
cuguaccacaaauguaccat

SEQ ID NO: 1728 - DNA, 20 bp, artificial sequence
  sense strand of an RNAi agent
  modified_base 1-19: /mod_base = "2'-hydroxy corresponding nucleoside"
uguaccacaaauguacccat

SEQ ID NO: 1729 - DNA, 20 bp, artificial sequence
  sense strand of an RNAi agent
  modified_base 1-19: /mod_base = "2'-hydroxy corresponding nucleoside"
ccacaaauguacccacaaat

SEQ ID NO: 1730 - DNA, 20 bp, artificial sequence
  sense strand of an RNAi agent
  modified_base 1-19: /mod_base = "2'-hydroxy corresponding nucleoside"
agaugccagugcaaggguat

SEQ ID NO: 1731 - DNA, 20 bp, artificial sequence
  sense strand of an RNAi agent
  modified_base 1-19: /mod_base = "2'-hydroxy corresponding nucleoside"
ggggucgcugccuagaggat

SEQ ID NO: 1732 - DNA, 20 bp, artificial sequence
  sense strand of an RNAi agent
  modified_base 1-19: /mod_base = "2'-hydroxy corresponding nucleoside"
gcugcuaugauggccgcgat

SEQ ID NO: 1733 - DNA, 20 bp, artificial sequence
  sense strand of an RNAi agent
  modified_base 1-19: /mod_base = "2'-hydroxy corresponding nucleoside"
cugcuaugauggccgcggat

SEQ ID NO: 1734 - DNA, 20 bp, artificial sequence
  sense strand of an RNAi agent
  modified_base 1-19: /mod_base = "2'-hydroxy corresponding nucleoside"
uggccgcgggcucagcuaat

SEQ ID NO: 1735 - DNA, 20 bp, artificial sequence
  sense strand of an RNAi agent
  modified_base 1-19: /mod_base = "2'-hydroxy corresponding nucleoside"
ccgcgggcucagcuaccgat

SEQ ID NO: 1736 - DNA, 20 bp, artificial sequence
  sense strand of an RNAi agent
  modified_base 1-19: /mod_base = "2'-hydroxy corresponding nucleoside"
gaccacgcucucgggugcat

SEQ ID NO: 1737 - DNA, 20 bp, artificial sequence
  sense strand of an RNAi agent
  modified_base 1-19: /mod_base = "2'-hydroxy corresponding nucleoside"
accacgcucucgggugcgat

SEQ ID NO: 1738 - DNA, 20 bp, artificial sequence
  sense strand of an RNAi agent
  modified_base 1-19: /mod_base = "2'-hydroxy corresponding nucleoside"
ccacgcucucgggugcgcat

SEQ ID NO: 1739 - DNA, 20 bp, artificial sequence
  sense strand of an RNAi agent
  modified_base 1-19: /mod_base = "2'-hydroxy corresponding nucleoside"
ggacugggcggccacgccat

SEQ ID NO: 1740 - DNA, 20 bp, artificial sequence
  sense strand of an RNAi agent
  modified_base 1-19: /mod_base = "2'-hydroxy corresponding nucleoside"
gccggaacccggacaacgat

SEQ ID NO: 1741 - DNA, 20 bp, artificial sequence
  sense strand of an RNAi agent
  modified_base 1-19: /mod_base = "2'-hydroxy corresponding nucleoside"
cggaacccggacaacgacat

SEQ ID NO: 1742 - DNA, 20 bp, artificial sequence
  sense strand of an RNAi agent
  modified_base 1-19: /mod_base = "2'-hydroxy corresponding nucleoside"
ggaacccggacaacgacaat

SEQ ID NO: 1743 - DNA, 20 bp, artificial sequence
  sense strand of an RNAi agent
  modified_base 1-19: /mod_base = "2'-hydroxy corresponding nucleoside"
gaacccggacaacgacauat

SEQ ID NO: 1744 - DNA, 20 bp, artificial sequence
  sense strand of an RNAi agent
  modified_base 1-19: /mod_base = "2'-hydroxy corresponding nucleoside"
ccggacaacgacauccgcat

SEQ ID NO: 1745 - DNA, 20 bp, artificial sequence
  sense strand of an RNAi agent
  modified_base 1-19: /mod_base = "2'-hydroxy corresponding nucleoside"
acaacgacauccgcccguat

SEQ ID NO: 1746 - DNA, 20 bp, artificial sequence
  sense strand of an RNAi agent
  modified_base 1-19: /mod_base = "2'-hydroxy corresponding nucleoside"
caacgacauccgcccgugat

SEQ ID NO: 1747 - DNA, 20 bp, artificial sequence
  sense strand of an RNAi agent
  modified_base 1-19: /mod_base = "2'-hydroxy corresponding nucleoside"
aacgacauccgcccguggat

SEQ ID NO: 1748 - DNA, 20 bp, artificial sequence
  sense strand of an RNAi agent
  modified_base 1-19: /mod_base = "2'-hydroxy corresponding nucleoside"
acgacauccgcccgugguat

SEQ ID NO: 1749 - DNA, 20 bp, artificial sequence
  sense strand of an RNAi agent
  modified_base 1-19: /mod_base = "2'-hydroxy corresponding nucleoside"
cauccgcccguggugcuuat

SEQ ID NO: 1750 - DNA, 20 bp, artificial sequence
  sense strand of an RNAi agent
  modified_base 1-19: /mod_base = "2'-hydroxy corresponding nucleoside"
auccgcccguggugcuucat

SEQ ID NO: 1751 - DNA, 20 bp, artificial sequence
  sense strand of an RNAi agent
  modified_base 1-19: /mod_base = "2'-hydroxy corresponding nucleoside"
ccgcccguggugcuucguat

SEQ ID NO: 1752 - DNA, 20 bp, artificial sequence
  sense strand of an RNAi agent
  modified_base 1-19: /mod_base = "2'-hydroxy corresponding nucleoside"
gcccguggugcuucgugcat

SEQ ID NO: 1753 - DNA, 20 bp, artificial sequence
  sense strand of an RNAi agent
  modified_base 1-19: /mod_base = "2'-hydroxy corresponding nucleoside"
cuucaugucccacucaugat

SEQ ID NO: 1754 - DNA, 20 bp, artificial sequence
  sense strand of an RNAi agent
  modified_base 1-19: /mod_base = "2'-hydroxy corresponding nucleoside"
gcagccggcaccgccgaaat

SEQ ID NO: 1755 - DNA, 20 bp, artificial sequence
  sense strand of an RNAi agent
  modified_base 1-19: /mod_base = "2'-hydroxy corresponding nucleoside"
ggcuccgcaagagucuguat

SEQ ID NO: 1756 - DNA, 20 bp, artificial sequence
  sense strand of an RNAi agent
  modified_base 1-19: /mod_base = "2'-hydroxy corresponding nucleoside"
gcuccgcaagagucugucat

SEQ ID NO: 1757 - DNA, 20 bp, artificial sequence
  sense strand of an RNAi agent
  modified_base 1-19: /mod_base = "2'-hydroxy corresponding nucleoside"
gagucugucuucgaugacat

SEQ ID NO: 1758 - DNA, 20 bp, artificial sequence
  sense strand of an RNAi agent
  modified_base 1-19: /mod_base = "2'-hydroxy corresponding nucleoside"
agucugucuucgaugaccat

SEQ ID NO: 1759 - DNA, 20 bp, artificial sequence
  sense strand of an RNAi agent
  modified_base 1-19: /mod_base = "2'-hydroxy corresponding nucleoside"
gucuucgaugacccgcguat

SEQ ID NO: 1760 - DNA, 20 bp, artificial sequence
  sense strand of an RNAi agent
  modified_base 1-19: /mod_base = "2'-hydroxy corresponding nucleoside"
ucuucgaugacccgcgucat

SEQ ID NO: 1761 - DNA, 20 bp, artificial sequence
  sense strand of an RNAi agent
  modified_base 1-19: /mod_base = "2'-hydroxy corresponding nucleoside"
cuucgaugacccgcgucgat

SEQ ID NO: 1762 - DNA, 20 bp, artificial sequence
  sense strand of an RNAi agent
  modified_base 1-19: /mod_base = "2'-hydroxy corresponding nucleoside"
uucgaugacccgcgucguat

SEQ ID NO: 1763 - DNA, 20 bp, artificial sequence
  sense strand of an RNAi agent
  modified_base 1-19: /mod_base = "2'-hydroxy corresponding nucleoside"
ucgaugacccgcgucguuat

SEQ ID NO: 1764 - DNA, 20 bp, artificial sequence
  sense strand of an RNAi agent
  modified_base 1-19: /mod_base = "2'-hydroxy corresponding nucleoside"
cgaugacccgcgucguugat

SEQ ID NO: 1765 - DNA, 20 bp, artificial sequence
  sense strand of an RNAi agent
  modified_base 1-19: /mod_base = "2'-hydroxy corresponding nucleoside"
gaugacccgcgucguuggat

SEQ ID NO: 1766 - DNA, 20 bp, artificial sequence
  sense strand of an RNAi agent
  modified_base 1-19: /mod_base = "2'-hydroxy corresponding nucleoside"
ugacccgcgucguuggcgat

SEQ ID NO: 1767 - DNA, 20 bp, artificial sequence
  sense strand of an RNAi agent
  modified_base 1-19: /mod_base = "2'-hydroxy corresponding nucleoside"
gacccgcgucguuggcggat

SEQ ID NO: 1768 - DNA, 20 bp, artificial sequence
  sense strand of an RNAi agent
  modified_base 1-19: /mod_base = "2'-hydroxy corresponding nucleoside"
gcugguggcgcuacgcggat

SEQ ID NO: 1769 - DNA, 20 bp, artificial sequence
  sense strand of an RNAi agent
  modified_base 1-19: /mod_base = "2'-hydroxy corresponding nucleoside"
ugguggcgcuacgcggggat

SEQ ID NO: 1770 - DNA, 20 bp, artificial sequence
  sense strand of an RNAi agent
  modified_base 1-19: /mod_base = "2'-hydroxy corresponding nucleoside"
gguggcgcuacgcggggcat

SEQ ID NO: 1771 - DNA, 20 bp, artificial sequence
  sense strand of an RNAi agent
  modified_base 1-19: /mod_base = "2'-hydroxy corresponding nucleoside"
guggcgcuacgcggggcgat

SEQ ID NO: 1772 - DNA, 20 bp, artificial sequence
  sense strand of an RNAi agent
  modified_base 1-19: /mod_base = "2'-hydroxy corresponding nucleoside"
gcuacgcggggcgcacccat

SEQ ID NO: 1773 - DNA, 20 bp, artificial sequence
  sense strand of an RNAi agent
  modified_base 1-19: /mod_base = "2'-hydroxy corresponding nucleoside"
ggcgcaccccuacaucgcat

SEQ ID NO: 1774 - DNA, 20 bp, artificial sequence
  sense strand of an RNAi agent
  modified_base 1-19: /mod_base = "2'-hydroxy corresponding nucleoside"
caccccuacaucgccgcgat

SEQ ID NO: 1775 - DNA, 20 bp, artificial sequence
  sense strand of an RNAi agent
  modified_base 1-19: /mod_base = "2'-hydroxy corresponding nucleoside"
ccccuacaucgccgcgcuat

SEQ ID NO: 1776 - DNA, 20 bp, artificial sequence
  sense strand of an RNAi agent
  modified_base 1-19: /mod_base = "2'-hydroxy corresponding nucleoside"
cccuacaucgccgcgcugat

SEQ ID NO: 1777 - DNA, 20 bp, artificial sequence
  sense strand of an RNAi agent
  modified_base 1-19: /mod_base = "2'-hydroxy corresponding nucleoside"
ccuacaucgccgcgcuguat

SEQ ID NO: 1778 - DNA, 20 bp, artificial sequence
  sense strand of an RNAi agent
  modified_base 1-19: /mod_base = "2'-hydroxy corresponding nucleoside"
cuacaucgccgcgcuguaat

SEQ ID NO: 1779 - DNA, 20 bp, artificial sequence
  sense strand of an RNAi agent
  modified_base 1-19: /mod_base = "2'-hydroxy corresponding nucleoside"
uacaucgccgcgcuguacat

SEQ ID NO: 1780 - DNA, 20 bp, artificial sequence
  sense strand of an RNAi agent
  modified_base 1-19: /mod_base = "2'-hydroxy corresponding nucleoside"
caucgccgcgcuguacugat

SEQ ID NO: 1781 - DNA, 20 bp, artificial sequence
  sense strand of an RNAi agent
  modified_base 1-19: /mod_base = "2'-hydroxy corresponding nucleoside"
ucgccgcgcuguacugggat

SEQ ID NO: 1782 - DNA, 20 bp, artificial sequence
  sense strand of an RNAi agent
  modified_base 1-19: /mod_base = "2'-hydroxy corresponding nucleoside"
cugcgccggcagccucauat

SEQ ID NO: 1783 - DNA, 20 bp, artificial sequence
  sense strand of an RNAi agent
  modified_base 1-19: /mod_base = "2'-hydroxy corresponding nucleoside"
gcacccgaggaucugacgat

SEQ ID NO: 1784 - DNA, 20 bp, artificial sequence
  sense strand of an RNAi agent
  modified_base 1-19: /mod_base = "2'-hydroxy corresponding nucleoside"
cacccgaggaucugacggat

SEQ ID NO: 1785 - DNA, 20 bp, artificial sequence
  sense strand of an RNAi agent
  modified_base 1-19: /mod_base = "2'-hydroxy corresponding nucleoside"
uugcacgaggccuucucgat

SEQ ID NO: 1786 - DNA, 20 bp, artificial sequence
  sense strand of an RNAi agent
  modified_base 1-19: /mod_base = "2'-hydroxy corresponding nucleoside"
ugcacgaggccuucucgcat

SEQ ID NO: 1787 - DNA, 20 bp, artificial sequence
  sense strand of an RNAi agent
  modified_base 1-19: /mod_base = "2'-hydroxy corresponding nucleoside"
gcacgaccuggcucuguuat

SEQ ID NO: 1788 - DNA, 20 bp, artificial sequence
  sense strand of an RNAi agent
  modified_base 1-19: /mod_base = "2'-hydroxy corresponding nucleoside"
gcucuguugcgccuucagat

SEQ ID NO: 1789 - DNA, 20 bp, artificial sequence
  sense strand of an RNAi agent
  modified_base 1-19: /mod_base = "2'-hydroxy corresponding nucleoside"
uugcgccuucaggaggauat

SEQ ID NO: 1790 - DNA, 20 bp, artificial sequence
  sense strand of an RNAi agent
  modified_base 1-19: /mod_base = "2'-hydroxy corresponding nucleoside"
ggacggcagcugcgcgcuat

SEQ ID NO: 1791 - DNA, 20 bp, artificial sequence
  sense strand of an RNAi agent
  modified_base 1-19: /mod_base = "2'-hydroxy corresponding nucleoside"
cgcgcuccugucgccuuaat

SEQ ID NO: 1792 - DNA, 20 bp, artificial sequence
  sense strand of an RNAi agent
  modified_base 1-19: /mod_base = "2'-hydroxy corresponding nucleoside"
gcgcuccugucgccuuacat

SEQ ID NO: 1793 - DNA, 20 bp, artificial sequence
  sense strand of an RNAi agent
  modified_base 1-19: /mod_base = "2'-hydroxy corresponding nucleoside"
cgcuccugucgccuuacgat

SEQ ID NO: 1794 - DNA, 20 bp, artificial sequence
  sense strand of an RNAi agent
  modified_base 1-19: /mod_base = "2'-hydroxy corresponding nucleoside"
gcuccugucgccuuacguat

SEQ ID NO: 1795 - DNA, 20 bp, artificial sequence
  sense strand of an RNAi agent
  modified_base 1-19: /mod_base = "2'-hydroxy corresponding nucleoside"
cuccugucgccuuacguuat

SEQ ID NO: 1796 - DNA, 20 bp, artificial sequence
  sense strand of an RNAi agent
  modified_base 1-19: /mod_base = "2'-hydroxy corresponding nucleoside"
uccugucgccuuacguucat

SEQ ID NO: 1797 - DNA, 20 bp, artificial sequence
  sense strand of an RNAi agent
  modified_base 1-19: /mod_base = "2'-hydroxy corresponding nucleoside"
ugucgccuuacguucagcat

SEQ ID NO: 1798 - DNA, 20 bp, artificial sequence
  sense strand of an RNAi agent
  modified_base 1-19: /mod_base = "2'-hydroxy corresponding nucleoside"
gucgccuuacguucagccat

SEQ ID NO: 1799 - DNA, 20 bp, artificial sequence
  sense strand of an RNAi agent
  modified_base 1-19: /mod_base = "2'-hydroxy corresponding nucleoside"
ucgccuuacguucagccgat

SEQ ID NO: 1800 - DNA, 20 bp, artificial sequence
  sense strand of an RNAi agent
  modified_base 1-19: /mod_base = "2'-hydroxy corresponding nucleoside"
cgccuuacguucagccggat

SEQ ID NO: 1801 - DNA, 20 bp, artificial sequence
  sense strand of an RNAi agent
  modified_base 1-19: /mod_base = "2'-hydroxy corresponding nucleoside"
gccuuacguucagccgguat

SEQ ID NO: 1802 - DNA, 20 bp, artificial sequence
  sense strand of an RNAi agent
  modified_base 1-19: /mod_base = "2'-hydroxy corresponding nucleoside"
cuuacguucagccgguguat

SEQ ID NO: 1803 - DNA, 20 bp, artificial sequence
  sense strand of an RNAi agent
  modified_base 1-19: /mod_base = "2'-hydroxy corresponding nucleoside"
acguucagccggugugccat

SEQ ID NO: 1804 - DNA, 20 bp, artificial sequence
  sense strand of an RNAi agent
  modified_base 1-19: /mod_base = "2'-hydroxy corresponding nucleoside"
ggugugccugccaagcggat

SEQ ID NO: 1805 - DNA, 20 bp, artificial sequence
  sense strand of an RNAi agent
  modified_base 1-19: /mod_base = "2'-hydroxy corresponding nucleoside"
gccaccaguucgagggggat

SEQ ID NO: 1806 - DNA, 20 bp, artificial sequence
  sense strand of an RNAi agent
  modified_base 1-19: /mod_base = "2'-hydroxy corresponding nucleoside"
caccaguucgagggggcgat

SEQ ID NO: 1807 - DNA, 20 bp, artificial sequence
  sense strand of an RNAi agent
  modified_base 1-19: /mod_base = "2'-hydroxy corresponding nucleoside"
ucgagggggcggaggaauat

SEQ ID NO: 1808 - DNA, 20 bp, artificial sequence
  sense strand of an RNAi agent
  modified_base 1-19: /mod_base = "2'-hydroxy corresponding nucleoside"
cugcgcaggguuccucgaat

SEQ ID NO: 1809 - DNA, 20 bp, artificial sequence
  sense strand of an RNAi agent
  modified_base 1-19: /mod_base = "2'-hydroxy corresponding nucleoside"
ugcgcaggguuccucgagat

SEQ ID NO: 1810 - DNA, 20 bp, artificial sequence
  sense strand of an RNAi agent
  modified_base 1-19: /mod_base = "2'-hydroxy corresponding nucleoside"
gcgcaggguuccucgaggat

SEQ ID NO: 1811 - DNA, 20 bp, artificial sequence
  sense strand of an RNAi agent
  modified_base 1-19: /mod_base = "2'-hydroxy corresponding nucleoside"
uuccucgagggcggcaccat

SEQ ID NO: 1812 - DNA, 20 bp, artificial sequence
  sense strand of an RNAi agent
  modified_base 1-19: /mod_base = "2'-hydroxy corresponding nucleoside"
cucgagggcggcaccgauat

SEQ ID NO: 1813 - DNA, 20 bp, artificial sequence
  sense strand of an RNAi agent
  modified_base 1-19: /mod_base = "2'-hydroxy corresponding nucleoside"
ucgagggcggcaccgaugat

SEQ ID NO: 1814 - DNA, 20 bp, artificial sequence
  sense strand of an RNAi agent
  modified_base 1-19: /mod_base = "2'-hydroxy corresponding nucleoside"
cagagcgccggcucacccat

SEQ ID NO: 1815 - DNA, 20 bp, artificial sequence
  sense strand of an RNAi agent
  modified_base 1-19: /mod_base = "2'-hydroxy corresponding nucleoside"
aucagcuggggaucgggcat

SEQ ID NO: 1816 - DNA, 20 bp, artificial sequence
  sense strand of an RNAi agent
  modified_base 1-19: /mod_base = "2'-hydroxy corresponding nucleoside"
gaucgggcuguggugaccat

SEQ ID NO: 1817 - DNA, 20 bp, artificial sequence
  sense strand of an RNAi agent
  modified_base 1-19: /mod_base = "2'-hydroxy corresponding nucleoside"
ccgcaacaagccaggcguat

SEQ ID NO: 1818 - DNA, 20 bp, artificial sequence
  sense strand of an RNAi agent
  modified_base 1-19: /mod_base = "2'-hydroxy corresponding nucleoside"
gcaacaagccaggcgucuat

SEQ ID NO: 1819 - DNA, 20 bp, artificial sequence
  sense strand of an RNAi agent
  modified_base 1-19: /mod_base = "2'-hydroxy corresponding nucleoside"
aggcgucuacaccgauguat

SEQ ID NO: 1820 - DNA, 20 bp, artificial sequence
  sense strand of an RNAi agent
  modified_base 1-19: /mod_base = "2'-hydroxy corresponding nucleoside"
ggcgucuacaccgaugugat

SEQ ID NO: 1821 - DNA, 20 bp, artificial sequence
  sense strand of an RNAi agent
  modified_base 1-19: /mod_base = "2'-hydroxy corresponding nucleoside"
gcgucuacaccgauguggat

SEQ ID NO: 1822 - DNA, 20 bp, artificial sequence
  sense strand of an RNAi agent
  modified_base 1-19: /mod_base = "2'-hydroxy corresponding nucleoside"
cuggauccgggagcacacat

SEQ ID NO: 1823 - DNA, 20 bp, artificial sequence
  sense strand of an RNAi agent
  modified_base 1-19: /mod_base = "2'-hydroxy corresponding nucleoside"
cugauugcucagggacucat

SEQ ID NO: 1824 - DNA, 20 bp, artificial sequence
  sense strand of an RNAi agent
  modified_base 1-19: /mod_base = "2'-hydroxy corresponding nucleoside"
auugcucagggacucaucat

SEQ ID NO: 1825 - DNA, 20 bp, artificial sequence
  sense strand of an RNAi agent
  modified_base 1-19: /mod_base = "2'-hydroxy corresponding nucleoside"
aggaacucaauaaagugcat

SEQ ID NO: 1826 - DNA, 20 bp, artificial sequence
  sense strand of an RNAi agent
  modified_base 1-19: /mod_base = "2'-hydroxy corresponding nucleoside"
ggaacucaauaaagugcuat

SEQ ID NO: 1827 - DNA, 21 bp, artificial sequence
  antisense strand of an RNAi agent
  modified_base 2-19: /mod_base = "2'-hydroxy corresponding nucleoside"
tucgaaaguguugacuccatt

SEQ ID NO: 1828 - DNA, 21 bp, artificial sequence
  antisense strand of an RNAi agent
  modified_base 2-19: /mod_base = "2'-hydroxy corresponding nucleoside"
taucgaaaguguugacucctt

SEQ ID NO: 1829 - DNA, 21 bp, artificial sequence
  antisense strand of an RNAi agent
  modified_base 2-19: /mod_base = "2'-hydroxy corresponding nucleoside"
tguacuuaugcuccuugggtt

SEQ ID NO: 1830 - DNA, 21 bp, artificial sequence
  antisense strand of an RNAi agent
  modified_base 2-19: /mod_base = "2'-hydroxy corresponding nucleoside"
tuguacuuaugcuccuuggtt

SEQ ID NO: 1831 - DNA, 21 bp, artificial sequence
  antisense strand of an RNAi agent
  modified_base 2-19: /mod_base = "2'-hydroxy corresponding nucleoside"
tuuguacuuaugcuccuugtt

SEQ ID NO: 1832 - DNA, 21 bp, artificial sequence
  antisense strand of an RNAi agent
  modified_base 2-19: /mod_base = "2'-hydroxy corresponding nucleoside"
tcagcuuuguacuuaugcutt

SEQ ID NO: 1833 - DNA, 21 bp, artificial sequence
  antisense strand of an RNAi agent
  modified_base 2-19: /mod_base = "2'-hydroxy corresponding nucleoside"
tacgacugugugcucuucatt

SEQ ID NO: 1834 - DNA, 21 bp, artificial sequence
  antisense strand of an RNAi agent
  modified_base 2-19: /mod_base = "2'-hydroxy corresponding nucleoside"
taacgacugugugcucuuctt

SEQ ID NO: 1835 - DNA, 21 bp, artificial sequence
  antisense strand of an RNAi agent
  modified_base 2-19: /mod_base = "2'-hydroxy corresponding nucleoside"
tgaacgacugugugcucuutt

SEQ ID NO: 1836 - DNA, 21 bp, artificial sequence
  antisense strand of an RNAi agent
  modified_base 2-19: /mod_base = "2'-hydroxy corresponding nucleoside"
tacagugagaacgacugugtt

SEQ ID NO: 1837 - DNA, 21 bp, artificial sequence
  antisense strand of an RNAi agent
  modified_base 2-19: /mod_base = "2'-hydroxy corresponding nucleoside"
tugacagugagaacgacugtt

SEQ ID NO: 1838 - DNA, 21 bp, artificial sequence
  antisense strand of an RNAi agent
  modified_base 2-19: /mod_base = "2'-hydroxy corresponding nucleoside"
tguacauuugugguacagctt

SEQ ID NO: 1839 - DNA, 21 bp, artificial sequence
  antisense strand of an RNAi agent
  modified_base 2-19: /mod_base = "2'-hydroxy corresponding nucleoside"
tgguacauuugugguacagtt

SEQ ID NO: 1840 - DNA, 21 bp, artificial sequence
  antisense strand of an RNAi agent
  modified_base 2-19: /mod_base = "2'-hydroxy corresponding nucleoside"
tggguacauuugugguacatt

SEQ ID NO: 1841 - DNA, 21 bp, artificial sequence
  antisense strand of an RNAi agent
  modified_base 2-19: /mod_base = "2'-hydroxy corresponding nucleoside"
tuuguggguacauuuguggtt

SEQ ID NO: 1842 - DNA, 21 bp, artificial sequence
  antisense strand of an RNAi agent
  modified_base 2-19: /mod_base = "2'-hydroxy corresponding nucleoside"
tacccuugcacuggcaucutt

SEQ ID NO: 1843 - DNA, 21 bp, artificial sequence
  antisense strand of an RNAi agent
  modified_base 2-19: /mod_base = "2'-hydroxy corresponding nucleoside"
tccucuaggcagcgacccctt

SEQ ID NO: 1844 - DNA, 21 bp, artificial sequence
  antisense strand of an RNAi agent
  modified_base 2-19: /mod_base = "2'-hydroxy corresponding nucleoside"
tcgcggccaucauagcagctt

SEQ ID NO: 1845 - DNA, 21 bp, artificial sequence
  antisense strand of an RNAi agent
  modified_base 2-19: /mod_base = "2'-hydroxy corresponding nucleoside"
tccgcggccaucauagcagtt

SEQ ID NO: 1846 - DNA, 21 bp, artificial sequence
  antisense strand of an RNAi agent
  modified_base 2-19: /mod_base = "2'-hydroxy corresponding nucleoside"
tuagcugagcccgcggccatt

SEQ ID NO: 1847 - DNA, 21 bp, artificial sequence
  antisense strand of an RNAi agent
  modified_base 2-19: /mod_base = "2'-hydroxy corresponding nucleoside"
tcgguagcugagcccgcggtt

SEQ ID NO: 1848 - DNA, 21 bp, artificial sequence
  antisense strand of an RNAi agent
  modified_base 2-19: /mod_base = "2'-hydroxy corresponding nucleoside"
tgcacccgagagcgugguctt

SEQ ID NO: 1849 - DNA, 21 bp, artificial sequence
  antisense strand of an RNAi agent
  modified_base 2-19: /mod_base = "2'-hydroxy corresponding nucleoside"
tcgcacccgagagcguggutt

SEQ ID NO: 1850 - DNA, 21 bp, artificial sequence
  antisense strand of an RNAi agent
  modified_base 2-19: /mod_base = "2'-hydroxy corresponding nucleoside"
tgcgcacccgagagcguggtt

SEQ ID NO: 1851 - DNA, 21 bp, artificial sequence
  antisense strand of an RNAi agent
  modified_base 2-19: /mod_base = "2'-hydroxy corresponding nucleoside"
tguccccaguuccgcgcuutt

SEQ ID NO: 1852 - DNA, 21 bp, artificial sequence
  antisense strand of an RNAi agent
  modified_base 2-19: /mod_base = "2'-hydroxy corresponding nucleoside"
tggcguggccgcccagucctt

SEQ ID NO: 1853 - DNA, 21 bp, artificial sequence
  antisense strand of an RNAi agent
  modified_base 2-19: /mod_base = "2'-hydroxy corresponding nucleoside"
tcguuguccggguuccggctt

SEQ ID NO: 1854 - DNA, 21 bp, artificial sequence
  antisense strand of an RNAi agent
  modified_base 2-19: /mod_base = "2'-hydroxy corresponding nucleoside"
tgucguuguccggguuccgtt

SEQ ID NO: 1855 - DNA, 21 bp, artificial sequence
  antisense strand of an RNAi agent
  modified_base 2-19: /mod_base = "2'-hydroxy corresponding nucleoside"
tugucguuguccggguucctt

SEQ ID NO: 1856 - DNA, 21 bp, artificial sequence
  antisense strand of an RNAi agent
  modified_base 2-19: /mod_base = "2'-hydroxy corresponding nucleoside"
taugucguuguccggguuctt

SEQ ID NO: 1857 - DNA, 21 bp, artificial sequence
  antisense strand of an RNAi agent
  modified_base 2-19: /mod_base = "2'-hydroxy corresponding nucleoside"
tgcggaugucguuguccggtt

SEQ ID NO: 1858 - DNA, 21 bp, artificial sequence
  antisense strand of an RNAi agent
  modified_base 2-19: /mod_base = "2'-hydroxy corresponding nucleoside"
tacgggcggaugucguugutt

SEQ ID NO: 1859 - DNA, 21 bp, artificial sequence
  antisense strand of an RNAi agent
  modified_base 2-19: /mod_base = "2'-hydroxy corresponding nucleoside"
tcacgggcggaugucguugtt

SEQ ID NO: 1860 - DNA, 21 bp, artificial sequence
  antisense strand of an RNAi agent
  modified_base 2-19: /mod_base = "2'-hydroxy corresponding nucleoside"
tccacgggcggaugucguutt

SEQ ID NO: 1861 - DNA, 21 bp, artificial sequence
  antisense strand of an RNAi agent
  modified_base 2-19: /mod_base = "2'-hydroxy corresponding nucleoside"
taccacgggcggaugucgutt

SEQ ID NO: 1862 - DNA, 21 bp, artificial sequence
  antisense strand of an RNAi agent
  modified_base 2-19: /mod_base = "2'-hydroxy corresponding nucleoside"
taagcaccacgggcggaugtt

SEQ ID NO: 1863 - DNA, 21 bp, artificial sequence
  antisense strand of an RNAi agent
  modified_base 2-19: /mod_base = "2'-hydroxy corresponding nucleoside"
tgaagcaccacgggcggautt

SEQ ID NO: 1864 - DNA, 21 bp, artificial sequence
  antisense strand of an RNAi agent
  modified_base 2-19: /mod_base = "2'-hydroxy corresponding nucleoside"
tacgaagcaccacgggcggtt

SEQ ID NO: 1865 - DNA, 21 bp, artificial sequence
  antisense strand of an RNAi agent
  modified_base 2-19: /mod_base = "2'-hydroxy corresponding nucleoside"
tgcacgaagcaccacgggctt

SEQ ID NO: 1866 - DNA, 21 bp, artificial sequence
  antisense strand of an RNAi agent
  modified_base 2-19: /mod_base = "2'-hydroxy corresponding nucleoside"
tcaugagugggacaugaagtt

SEQ ID NO: 1867 - DNA, 21 bp, artificial sequence
  antisense strand of an RNAi agent
  modified_base 2-19: /mod_base = "2'-hydroxy corresponding nucleoside"
tuucggcggugccggcugctt

SEQ ID NO: 1868 - DNA, 21 bp, artificial sequence
  antisense strand of an RNAi agent
  modified_base 2-19: /mod_base = "2'-hydroxy corresponding nucleoside"
tacagacucuugcggagcctt

SEQ ID NO: 1869 - DNA, 21 bp, artificial sequence
  antisense strand of an RNAi agent
  modified_base 2-19: /mod_base = "2'-hydroxy corresponding nucleoside"
tgacagacucuugcggagctt

SEQ ID NO: 1870 - DNA, 21 bp, artificial sequence
  antisense strand of an RNAi agent
  modified_base 2-19: /mod_base = "2'-hydroxy corresponding nucleoside"
tgucaucgaagacagacuctt

SEQ ID NO: 1871 - DNA, 21 bp, artificial sequence
  antisense strand of an RNAi agent
  modified_base 2-19: /mod_base = "2'-hydroxy corresponding nucleoside"
tggucaucgaagacagacutt

SEQ ID NO: 1872 - DNA, 21 bp, artificial sequence
  antisense strand of an RNAi agent
  modified_base 2-19: /mod_base = "2'-hydroxy corresponding nucleoside"
tacgcgggucaucgaagactt

SEQ ID NO: 1873 - DNA, 21 bp, artificial sequence
  antisense strand of an RNAi agent
  modified_base 2-19: /mod_base = "2'-hydroxy corresponding nucleoside"
tgacgcgggucaucgaagatt

SEQ ID NO: 1874 - DNA, 21 bp, artificial sequence
  antisense strand of an RNAi agent
  modified_base 2-19: /mod_base = "2'-hydroxy corresponding nucleoside"
tcgacgcgggucaucgaagtt

SEQ ID NO: 1875 - DNA, 21 bp, artificial sequence
  antisense strand of an RNAi agent
  modified_base 2-19: /mod_base = "2'-hydroxy corresponding nucleoside"
tacgacgcgggucaucgaatt

SEQ ID NO: 1876 - DNA, 21 bp, artificial sequence
  antisense strand of an RNAi agent
  modified_base 2-19: /mod_base = "2'-hydroxy corresponding nucleoside"
taacgacgcgggucaucgatt

SEQ ID NO: 1877 - DNA, 21 bp, artificial sequence
  antisense strand of an RNAi agent
  modified_base 2-19: /mod_base = "2'-hydroxy corresponding nucleoside"
tcaacgacgcgggucaucgtt

SEQ ID NO: 1878 - DNA, 21 bp, artificial sequence
  antisense strand of an RNAi agent
  modified_base 2-19: /mod_base = "2'-hydroxy corresponding nucleoside"
tccaacgacgcgggucauctt

SEQ ID NO: 1879 - DNA, 21 bp, artificial sequence
  antisense strand of an RNAi agent
  modified_base 2-19: /mod_base = "2'-hydroxy corresponding nucleoside"
tcgccaacgacgcgggucatt

SEQ ID NO: 1880 - DNA, 21 bp, artificial sequence
  antisense strand of an RNAi agent
  modified_base 2-19: /mod_base = "2'-hydroxy corresponding nucleoside"
tccgccaacgacgcggguctt

SEQ ID NO: 1881 - DNA, 21 bp, artificial sequence
  antisense strand of an RNAi agent
  modified_base 2-19: /mod_base = "2'-hydroxy corresponding nucleoside"
tccgcguagcgccaccagctt

SEQ ID NO: 1882 - DNA, 21 bp, artificial sequence
  antisense strand of an RNAi agent
  modified_base 2-19: /mod_base = "2'-hydroxy corresponding nucleoside"
tccccgcguagcgccaccatt

SEQ ID NO: 1883 - DNA, 21 bp, artificial sequence
  antisense strand of an RNAi agent
  modified_base 2-19: /mod_base = "2'-hydroxy corresponding nucleoside"
tgccccgcguagcgccacctt

SEQ ID NO: 1884 - DNA, 21 bp, artificial sequence
  antisense strand of an RNAi agent
  modified_base 2-19: /mod_base = "2'-hydroxy corresponding nucleoside"
tcgccccgcguagcgccactt

SEQ ID NO: 1885 - DNA, 21 bp, artificial sequence
  antisense strand of an RNAi agent
  modified_base 2-19: /mod_base = "2'-hydroxy corresponding nucleoside"
tgggugcgccccgcguagctt

SEQ ID NO: 1886 - DNA, 21 bp, artificial sequence
  antisense strand of an RNAi agent
  modified_base 2-19: /mod_base = "2'-hydroxy corresponding nucleoside"
tgcgauguaggggugcgcctt

SEQ ID NO: 1887 - DNA, 21 bp, artificial sequence
  antisense strand of an RNAi agent
  modified_base 2-19: /mod_base = "2'-hydroxy corresponding nucleoside"
tcgcggcgauguaggggugtt

SEQ ID NO: 1888 - DNA, 21 bp, artificial sequence
  antisense strand of an RNAi agent
  modified_base 2-19: /mod_base = "2'-hydroxy corresponding nucleoside"
tagcgcggcgauguaggggtt

SEQ ID NO: 1889 - DNA, 21 bp, artificial sequence
  antisense strand of an RNAi agent
  modified_base 2-19: /mod_base = "2'-hydroxy corresponding nucleoside"
tcagcgcggcgauguagggtt

SEQ ID NO: 1890 - DNA, 21 bp, artificial sequence
  antisense strand of an RNAi agent
  modified_base 2-19: /mod_base = "2'-hydroxy corresponding nucleoside"
tacagcgcggcgauguaggtt

SEQ ID NO: 1891 - DNA, 21 bp, artificial sequence
  antisense strand of an RNAi agent
  modified_base 2-19: /mod_base = "2'-hydroxy corresponding nucleoside"
tuacagcgcggcgauguagtt

SEQ ID NO: 1892 - DNA, 21 bp, artificial sequence
  antisense strand of an RNAi agent
  modified_base 2-19: /mod_base = "2'-hydroxy corresponding nucleoside"
tguacagcgcggcgauguatt

SEQ ID NO: 1893 - DNA, 21 bp, artificial sequence
  antisense strand of an RNAi agent
  modified_base 2-19: /mod_base = "2'-hydroxy corresponding nucleoside"
tcaguacagcgcggcgaugtt

SEQ ID NO: 1894 - DNA, 21 bp, artificial sequence
  antisense strand of an RNAi agent
  modified_base 2-19: /mod_base = "2'-hydroxy corresponding nucleoside"
tcccaguacagcgcggcgatt

SEQ ID NO: 1895 - DNA, 21 bp, artificial sequence
  antisense strand of an RNAi agent
  modified_base 2-19: /mod_base = "2'-hydroxy corresponding nucleoside"
taugaggcugccggcgcagtt

SEQ ID NO: 1896 - DNA, 21 bp, artificial sequence
  antisense strand of an RNAi agent
  modified_base 2-19: /mod_base = "2'-hydroxy corresponding nucleoside"
tcgucagauccucgggugctt

SEQ ID NO: 1897 - DNA, 21 bp, artificial sequence
  antisense strand of an RNAi agent
  modified_base 2-19: /mod_base = "2'-hydroxy corresponding nucleoside"
tccgucagauccucgggugtt

SEQ ID NO: 1898 - DNA, 21 bp, artificial sequence
  antisense strand of an RNAi agent
  modified_base 2-19: /mod_base = "2'-hydroxy corresponding nucleoside"
tcgagaaggccucgugcaatt

SEQ ID NO: 1899 - DNA, 21 bp, artificial sequence
  antisense strand of an RNAi agent
  modified_base 2-19: /mod_base = "2'-hydroxy corresponding nucleoside"
tgcgagaaggccucgugcatt

SEQ ID NO: 1900 - DNA, 21 bp, artificial sequence
  antisense strand of an RNAi agent
  modified_base 2-19: /mod_base = "2'-hydroxy corresponding nucleoside"
taacagagccaggucgugctt

SEQ ID NO: 1901 - DNA, 21 bp, artificial sequence
  antisense strand of an RNAi agent
  modified_base 2-19: /mod_base = "2'-hydroxy corresponding nucleoside"
tcugaaggcgcaacagagctt

SEQ ID NO: 1902 - DNA, 21 bp, artificial sequence
  antisense strand of an RNAi agent
  modified_base 2-19: /mod_base = "2'-hydroxy corresponding nucleoside"
tauccuccugaaggcgcaatt

SEQ ID NO: 1903 - DNA, 21 bp, artificial sequence
  antisense strand of an RNAi agent
  modified_base 2-19: /mod_base = "2'-hydroxy corresponding nucleoside"
tagcgcgcagcugccgucctt

SEQ ID NO: 1904 - DNA, 21 bp, artificial sequence
  antisense strand of an RNAi agent
  modified_base 2-19: /mod_base = "2'-hydroxy corresponding nucleoside"
tuaaggcgacaggagcgcgtt

SEQ ID NO: 1905 - DNA, 21 bp, artificial sequence
  antisense strand of an RNAi agent
  modified_base 2-19: /mod_base = "2'-hydroxy corresponding nucleoside"
tguaaggcgacaggagcgctt

SEQ ID NO: 1906 - DNA, 21 bp, artificial sequence
  antisense strand of an RNAi agent
  modified_base 2-19: /mod_base = "2'-hydroxy corresponding nucleoside"
tcguaaggcgacaggagcgtt

SEQ ID NO: 1907 - DNA, 21 bp, artificial sequence
  antisense strand of an RNAi agent
  modified_base 2-19: /mod_base = "2'-hydroxy corresponding nucleoside"
tacguaaggcgacaggagctt

SEQ ID NO: 1908 - DNA, 21 bp, artificial sequence
  antisense strand of an RNAi agent
  modified_base 2-19: /mod_base = "2'-hydroxy corresponding nucleoside"
taacguaaggcgacaggagtt

SEQ ID NO: 1909 - DNA, 21 bp, artificial sequence
  antisense strand of an RNAi agent
  modified_base 2-19: /mod_base = "2'-hydroxy corresponding nucleoside"
tgaacguaaggcgacaggatt

SEQ ID NO: 1910 - DNA, 21 bp, artificial sequence
  antisense strand of an RNAi agent
  modified_base 2-19: /mod_base = "2'-hydroxy corresponding nucleoside"
tgcugaacguaaggcgacatt

SEQ ID NO: 1911 - DNA, 21 bp, artificial sequence
  antisense strand of an RNAi agent
  modified_base 2-19: /mod_base = "2'-hydroxy corresponding nucleoside"
tggcugaacguaaggcgactt

SEQ ID NO: 1912 - DNA, 21 bp, artificial sequence
  antisense strand of an RNAi agent
  modified_base 2-19: /mod_base = "2'-hydroxy corresponding nucleoside"
tcggcugaacguaaggcgatt

SEQ ID NO: 1913 - DNA, 21 bp, artificial sequence
  antisense strand of an RNAi agent
  modified_base 2-19: /mod_base = "2'-hydroxy corresponding nucleoside"
tccggcugaacguaaggcgtt

SEQ ID NO: 1914 - DNA, 21 bp, artificial sequence
  antisense strand of an RNAi agent
  modified_base 2-19: /mod_base = "2'-hydroxy corresponding nucleoside"
taccggcugaacguaaggctt

SEQ ID NO: 1915 - DNA, 21 bp, artificial sequence
  antisense strand of an RNAi agent
  modified_base 2-19: /mod_base = "2'-hydroxy corresponding nucleoside"
tacaccggcugaacguaagtt

SEQ ID NO: 1916 - DNA, 21 bp, artificial sequence
  antisense strand of an RNAi agent
  modified_base 2-19: /mod_base = "2'-hydroxy corresponding nucleoside"
tggcacaccggcugaacgutt

SEQ ID NO: 1917 - DNA, 21 bp, artificial sequence
  antisense strand of an RNAi agent
  modified_base 2-19: /mod_base = "2'-hydroxy corresponding nucleoside"
tccgcuuggcaggcacacctt

SEQ ID NO: 1918 - DNA, 21 bp, artificial sequence
  antisense strand of an RNAi agent
  modified_base 2-19: /mod_base = "2'-hydroxy corresponding nucleoside"
tcccccucgaacugguggctt

SEQ ID NO: 1919 - DNA, 21 bp, artificial sequence
  antisense strand of an RNAi agent
  modified_base 2-19: /mod_base = "2'-hydroxy corresponding nucleoside"
tcgcccccucgaacuggugtt

SEQ ID NO: 1920 - DNA, 21 bp, artificial sequence
  antisense strand of an RNAi agent
  modified_base 2-19: /mod_base = "2'-hydroxy corresponding nucleoside"
tauuccuccgcccccucgatt

SEQ ID NO: 1921 - DNA, 21 bp, artificial sequence
  antisense strand of an RNAi agent
  modified_base 2-19: /mod_base = "2'-hydroxy corresponding nucleoside"
tucgaggaacccugcgcagtt

SEQ ID NO: 1922 - DNA, 21 bp, artificial sequence
  antisense strand of an RNAi agent
  modified_base 2-19: /mod_base = "2'-hydroxy corresponding nucleoside"
tcucgaggaacccugcgcatt

SEQ ID NO: 1923 - DNA, 21 bp, artificial sequence
  antisense strand of an RNAi agent
  modified_base 2-19: /mod_base = "2'-hydroxy corresponding nucleoside"
tccucgaggaacccugcgctt

SEQ ID NO: 1924 - DNA, 21 bp, artificial sequence
  antisense strand of an RNAi agent
  modified_base 2-19: /mod_base = "2'-hydroxy corresponding nucleoside"
tggugccgcccucgaggaatt

SEQ ID NO: 1925 - DNA, 21 bp, artificial sequence
  antisense strand of an RNAi agent
  modified_base 2-19: /mod_base = "2'-hydroxy corresponding nucleoside"
taucggugccgcccucgagtt

SEQ ID NO: 1926 - DNA, 21 bp, artificial sequence
  antisense strand of an RNAi agent
  modified_base 2-19: /mod_base = "2'-hydroxy corresponding nucleoside"
tcaucggugccgcccucgatt

SEQ ID NO: 1927 - DNA, 21 bp, artificial sequence
  antisense strand of an RNAi agent
  modified_base 2-19: /mod_base = "2'-hydroxy corresponding nucleoside"
tgggugagccggcgcucugtt

SEQ ID NO: 1928 - DNA, 21 bp, artificial sequence
  antisense strand of an RNAi agent
  modified_base 2-19: /mod_base = "2'-hydroxy corresponding nucleoside"
tgcccgauccccagcugautt

SEQ ID NO: 1929 - DNA, 21 bp, artificial sequence
  antisense strand of an RNAi agent
  modified_base 2-19: /mod_base = "2'-hydroxy corresponding nucleoside"
tggucaccacagcccgauctt

SEQ ID NO: 1930 - DNA, 21 bp, artificial sequence
  antisense strand of an RNAi agent
  modified_base 2-19: /mod_base = "2'-hydroxy corresponding nucleoside"
tacgccuggcuuguugcggtt

SEQ ID NO: 1931 - DNA, 21 bp, artificial sequence
  antisense strand of an RNAi agent
  modified_base 2-19: /mod_base = "2'-hydroxy corresponding nucleoside"
tagacgccuggcuuguugctt

SEQ ID NO: 1932 - DNA, 21 bp, artificial sequence
  antisense strand of an RNAi agent
  modified_base 2-19: /mod_base = "2'-hydroxy corresponding nucleoside"
tacaucgguguagacgccutt

SEQ ID NO: 1933 - DNA, 21 bp, artificial sequence
  antisense strand of an RNAi agent
  modified_base 2-19: /mod_base = "2'-hydroxy corresponding nucleoside"
tcacaucgguguagacgcctt

SEQ ID NO: 1934 - DNA, 21 bp, artificial sequence
  antisense strand of an RNAi agent
  modified_base 2-19: /mod_base = "2'-hydroxy corresponding nucleoside"
tccacaucgguguagacgctt

SEQ ID NO: 1935 - DNA, 21 bp, artificial sequence
  antisense strand of an RNAi agent
  modified_base 2-19: /mod_base = "2'-hydroxy corresponding nucleoside"
tgugugcucccggauccagtt

SEQ ID NO: 1936 - DNA, 21 bp, artificial sequence
  antisense strand of an RNAi agent
  modified_base 2-19: /mod_base = "2'-hydroxy corresponding nucleoside"
tgagucccugagcaaucagtt

SEQ ID NO: 1937 - DNA, 21 bp, artificial sequence
  antisense strand of an RNAi agent
  modified_base 2-19: /mod_base = "2'-hydroxy corresponding nucleoside"
tgaugagucccugagcaautt

SEQ ID NO: 1938 - DNA, 21 bp, artificial sequence
  antisense strand of an RNAi agent
  modified_base 2-19: /mod_base = "2'-hydroxy corresponding nucleoside"
tgcacuuuauugaguuccutt

SEQ ID NO: 1939 - DNA, 21 bp, artificial sequence
  antisense strand of an RNAi agent
  modified_base 2-19: /mod_base = "2'-hydroxy corresponding nucleoside"
tagcacuuuauugaguucctt

SEQ ID NO: 1940 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
uggagucaacacuuucgaat

SEQ ID NO: 1941 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ggagucaacacuuucgauat

SEQ ID NO: 1942 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cccaaggagcauaaguacat

SEQ ID NO: 1943 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ccaaggagcauaaguacaat

SEQ ID NO: 1944 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
caaggagcauaaguacaaat

SEQ ID NO: 1945 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
agcauaaguacaaagcugat

SEQ ID NO: 1946 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ugaagagcacacagucguat

SEQ ID NO: 1947 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gaagagcacacagucguuat

SEQ ID NO: 1948 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
aagagcacacagucguucat

SEQ ID NO: 1949 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cacagucguucucacuguat

SEQ ID NO: 1950 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cagucguucucacugucaat

SEQ ID NO: 1951 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcuguaccacaaauguacat

SEQ ID NO: 1952 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cuguaccacaaauguaccat

SEQ ID NO: 1953 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
uguaccacaaauguacccat

SEQ ID NO: 1954 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ccacaaauguacccacaaat

SEQ ID NO: 1955 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
agaugccagugcaaggguat

SEQ ID NO: 1956 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ggggucgcugccuagaggat

SEQ ID NO: 1957 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcugcuaugauggccgcgat

SEQ ID NO: 1958 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cugcuaugauggccgcggat

SEQ ID NO: 1959 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
uggccgcgggcucagcuaat

SEQ ID NO: 1960 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ccgcgggcucagcuaccgat

SEQ ID NO: 1961 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gaccacgcucucgggugcat

SEQ ID NO: 1962 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
accacgcucucgggugcgat

SEQ ID NO: 1963 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ccacgcucucgggugcgcat

SEQ ID NO: 1964 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
aagcgcggaacuggggacat

SEQ ID NO: 1965 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ggacugggcggccacgccat

SEQ ID NO: 1966 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gccggaacccggacaacgat

SEQ ID NO: 1967 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cggaacccggacaacgacat

SEQ ID NO: 1968 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ggaacccggacaacgacaat

SEQ ID NO: 1969 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gaacccggacaacgacauat

SEQ ID NO: 1970 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ccggacaacgacauccgcat

SEQ ID NO: 1971 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
acaacgacauccgcccguat

SEQ ID NO: 1972 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
caacgacauccgcccgugat

SEQ ID NO: 1973 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
aacgacauccgcccguggat

SEQ ID NO: 1974 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
acgacauccgcccgugguat

SEQ ID NO: 1975 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cauccgcccguggugcuuat

SEQ ID NO: 1976 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
auccgcccguggugcuucat

SEQ ID NO: 1977 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ccgcccguggugcuucguat

SEQ ID NO: 1978 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcccguggugcuucgugcat

SEQ ID NO: 1979 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cuucaugucccacucaugat

SEQ ID NO: 1980 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcagccggcaccgccgaaat

SEQ ID NO: 1981 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ggcuccgcaagagucuguat

SEQ ID NO: 1982 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcuccgcaagagucugucat

SEQ ID NO: 1983 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gagucugucuucgaugacat

SEQ ID NO: 1984 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
agucugucuucgaugaccat

SEQ ID NO: 1985 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gucuucgaugacccgcguat

SEQ ID NO: 1986 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ucuucgaugacccgcgucat

SEQ ID NO: 1987 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cuucgaugacccgcgucgat

SEQ ID NO: 1988 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
uucgaugacccgcgucguat

SEQ ID NO: 1989 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ucgaugacccgcgucguuat

SEQ ID NO: 1990 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cgaugacccgcgucguugat

SEQ ID NO: 1991 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gaugacccgcgucguuggat

SEQ ID NO: 1992 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ugacccgcgucguuggcgat

SEQ ID NO: 1993 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gacccgcgucguuggcggat

SEQ ID NO: 1994 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcugguggcgcuacgcggat

SEQ ID NO: 1995 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ugguggcgcuacgcggggat

SEQ ID NO: 1996 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gguggcgcuacgcggggcat

SEQ ID NO: 1997 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
guggcgcuacgcggggcgat

SEQ ID NO: 1998 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcuacgcggggcgcacccat

SEQ ID NO: 1999 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ggcgcaccccuacaucgcat

SEQ ID NO: 2000 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
caccccuacaucgccgcgat

SEQ ID NO: 2001 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ccccuacaucgccgcgcuat

SEQ ID NO: 2002 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cccuacaucgccgcgcugat

SEQ ID NO: 2003 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ccuacaucgccgcgcuguat

SEQ ID NO: 2004 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cuacaucgccgcgcuguaat

SEQ ID NO: 2005 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
uacaucgccgcgcuguacat

SEQ ID NO: 2006 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
caucgccgcgcuguacugat

SEQ ID NO: 2007 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ucgccgcgcuguacugggat

SEQ ID NO: 2008 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cugcgccggcagccucauat

SEQ ID NO: 2009 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcacccgaggaucugacgat

SEQ ID NO: 2010 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cacccgaggaucugacggat

SEQ ID NO: 2011 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
uugcacgaggccuucucgat

SEQ ID NO: 2012 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ugcacgaggccuucucgcat

SEQ ID NO: 2013 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcacgaccuggcucuguuat

SEQ ID NO: 2014 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcucuguugcgccuucagat

SEQ ID NO: 2015 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
uugcgccuucaggaggauat

SEQ ID NO: 2016 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ggacggcagcugcgcgcuat

SEQ ID NO: 2017 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cgcgcuccugucgccuuaat

SEQ ID NO: 2018 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcgcuccugucgccuuacat

SEQ ID NO: 2019 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cgcuccugucgccuuacgat

SEQ ID NO: 2020 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcuccugucgccuuacguat

SEQ ID NO: 2021 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cuccugucgccuuacguuat

SEQ ID NO: 2022 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
uccugucgccuuacguucat

SEQ ID NO: 2023 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ugucgccuuacguucagcat

SEQ ID NO: 2024 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gucgccuuacguucagccat

SEQ ID NO: 2025 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ucgccuuacguucagccgat

SEQ ID NO: 2026 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cgccuuacguucagccggat

SEQ ID NO: 2027 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gccuuacguucagccgguat

SEQ ID NO: 2028 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cuuacguucagccgguguat

SEQ ID NO: 2029 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
acguucagccggugugccat

SEQ ID NO: 2030 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ggugugccugccaagcggat

SEQ ID NO: 2031 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gccaccaguucgagggggat

SEQ ID NO: 2032 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
caccaguucgagggggcgat

SEQ ID NO: 2033 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ucgagggggcggaggaauat

SEQ ID NO: 2034 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cugcgcaggguuccucgaat

SEQ ID NO: 2035 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ugcgcaggguuccucgagat

SEQ ID NO: 2036 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcgcaggguuccucgaggat

SEQ ID NO: 2037 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
uuccucgagggcggcaccat

SEQ ID NO: 2038 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cucgagggcggcaccgauat

SEQ ID NO: 2039 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ucgagggcggcaccgaugat

SEQ ID NO: 2040 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cagagcgccggcucacccat

SEQ ID NO: 2041 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
aucagcuggggaucgggcat

SEQ ID NO: 2042 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gaucgggcuguggugaccat

SEQ ID NO: 2043 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ccgcaacaagccaggcguat

SEQ ID NO: 2044 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcaacaagccaggcgucuat

SEQ ID NO: 2045 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
aggcgucuacaccgauguat

SEQ ID NO: 2046 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ggcgucuacaccgaugugat

SEQ ID NO: 2047 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
gcgucuacaccgauguggat

SEQ ID NO: 2048 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cuggauccgggagcacacat

SEQ ID NO: 2049 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
cugauugcucagggacucat

SEQ ID NO: 2050 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
auugcucagggacucaucat

SEQ ID NO: 2051 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
aggaacucaauaaagugcat

SEQ ID NO: 2052 - DNA, 20 bp, artificial sequence
  sense strand of an RNAi agent
  modified_base 1,3,5,7,9,11,13,15,17,19: /mod_base = "2'-deoxy-2'-fluoro corresponding nucleoside"
  modified_base 2,4,6,8,10,12,14,16,18: /mod_base = "2'-O-methyl corresponding nucleoside"
ggaacucaauaaagugcuat

SEQ ID NO: 2053 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucgaaaguguugacuccatt

SEQ ID NO: 2054 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taucgaaaguguugacucctt

SEQ ID NO: 2055 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguacuuaugcuccuugggtt

SEQ ID NO: 2056 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuguacuuaugcuccuuggtt

SEQ ID NO: 2057 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuuguacuuaugcuccuugtt

SEQ ID NO: 2058 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcagcuuuguacuuaugcutt

SEQ ID NO: 2059 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacgacugugugcucuucatt

SEQ ID NO: 2060 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taacgacugugugcucuuctt

SEQ ID NO: 2061 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgaacgacugugugcucuutt

SEQ ID NO: 2062 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacagugagaacgacugugtt

SEQ ID NO: 2063 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tugacagugagaacgacugtt

SEQ ID NO: 2064 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguacauuugugguacagctt

SEQ ID NO: 2065 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgguacauuugugguacagtt

SEQ ID NO: 2066 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggguacauuugugguacatt

SEQ ID NO: 2067 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuuguggguacauuuguggtt

SEQ ID NO: 2068 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacccuugcacuggcaucutt

SEQ ID NO: 2069 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccucuaggcagcgacccctt

SEQ ID NO: 2070 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgcggccaucauagcagctt

SEQ ID NO: 2071 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccgcggccaucauagcagtt

SEQ ID NO: 2072 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuagcugagcccgcggccatt

SEQ ID NO: 2073 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgguagcugagcccgcggtt

SEQ ID NO: 2074 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcacccgagagcgugguctt

SEQ ID NO: 2075 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgcacccgagagcguggutt

SEQ ID NO: 2076 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcgcacccgagagcguggtt

SEQ ID NO: 2077 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguccccaguuccgcgcuutt

SEQ ID NO: 2078 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggcguggccgcccagucctt

SEQ ID NO: 2079 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcguuguccggguuccggctt

SEQ ID NO: 2080 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgucguuguccggguuccgtt

SEQ ID NO: 2081 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tugucguuguccggguucctt

SEQ ID NO: 2082 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taugucguuguccggguuctt

SEQ ID NO: 2083 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcggaugucguuguccggtt

SEQ ID NO: 2084 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacgggcggaugucguugutt

SEQ ID NO: 2085 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcacgggcggaugucguugtt

SEQ ID NO: 2086 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccacgggcggaugucguutt

SEQ ID NO: 2087 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taccacgggcggaugucgutt

SEQ ID NO: 2088 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taagcaccacgggcggaugtt

SEQ ID NO: 2089 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgaagcaccacgggcggautt

SEQ ID NO: 2090 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacgaagcaccacgggcggtt

SEQ ID NO: 2091 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcacgaagcaccacgggctt

SEQ ID NO: 2092 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcaugagugggacaugaagtt

SEQ ID NO: 2093 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuucggcggugccggcugctt

SEQ ID NO: 2094 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacagacucuugcggagcctt

SEQ ID NO: 2095 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgacagacucuugcggagctt

SEQ ID NO: 2096 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgucaucgaagacagacuctt

SEQ ID NO: 2097 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggucaucgaagacagacutt

SEQ ID NO: 2098 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacgcgggucaucgaagactt

SEQ ID NO: 2099 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgacgcgggucaucgaagatt

SEQ ID NO: 2100 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgacgcgggucaucgaagtt

SEQ ID NO: 2101 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacgacgcgggucaucgaatt

SEQ ID NO: 2102 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taacgacgcgggucaucgatt

SEQ ID NO: 2103 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcaacgacgcgggucaucgtt

SEQ ID NO: 2104 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccaacgacgcgggucauctt

SEQ ID NO: 2105 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgccaacgacgcgggucatt

SEQ ID NO: 2106 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccgccaacgacgcggguctt

SEQ ID NO: 2107 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccgcguagcgccaccagctt

SEQ ID NO: 2108 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccccgcguagcgccaccatt

SEQ ID NO: 2109 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgccccgcguagcgccacctt

SEQ ID NO: 2110 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgccccgcguagcgccactt

SEQ ID NO: 2111 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgggugcgccccgcguagctt

SEQ ID NO: 2112 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcgauguaggggugcgcctt

SEQ ID NO: 2113 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgcggcgauguaggggugtt

SEQ ID NO: 2114 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tagcgcggcgauguaggggtt

SEQ ID NO: 2115 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcagcgcggcgauguagggtt

SEQ ID NO: 2116 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacagcgcggcgauguaggtt

SEQ ID NO: 2117 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuacagcgcggcgauguagtt

SEQ ID NO: 2118 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguacagcgcggcgauguatt

SEQ ID NO: 2119 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcaguacagcgcggcgaugtt

SEQ ID NO: 2120 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcccaguacagcgcggcgatt

SEQ ID NO: 2121 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taugaggcugccggcgcagtt

SEQ ID NO: 2122 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgucagauccucgggugctt

SEQ ID NO: 2123 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccgucagauccucgggugtt

SEQ ID NO: 2124 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgagaaggccucgugcaatt

SEQ ID NO: 2125 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcgagaaggccucgugcatt

SEQ ID NO: 2126 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taacagagccaggucgugctt

SEQ ID NO: 2127 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcugaaggcgcaacagagctt

SEQ ID NO: 2128 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tauccuccugaaggcgcaatt

SEQ ID NO: 2129 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tagcgcgcagcugccgucctt

SEQ ID NO: 2130 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tuaaggcgacaggagcgcgtt

SEQ ID NO: 2131 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tguaaggcgacaggagcgctt

SEQ ID NO: 2132 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcguaaggcgacaggagcgtt

SEQ ID NO: 2133 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacguaaggcgacaggagctt

SEQ ID NO: 2134 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taacguaaggcgacaggagtt

SEQ ID NO: 2135 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgaacguaaggcgacaggatt

SEQ ID NO: 2136 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcugaacguaaggcgacatt

SEQ ID NO: 2137 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggcugaacguaaggcgactt

SEQ ID NO: 2138 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcggcugaacguaaggcgatt

SEQ ID NO: 2139 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccggcugaacguaaggcgtt

SEQ ID NO: 2140 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taccggcugaacguaaggctt

SEQ ID NO: 2141 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacaccggcugaacguaagtt

SEQ ID NO: 2142 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggcacaccggcugaacgutt

SEQ ID NO: 2143 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccgcuuggcaggcacacctt

SEQ ID NO: 2144 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcccccucgaacugguggctt

SEQ ID NO: 2145 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcgcccccucgaacuggugtt

SEQ ID NO: 2146 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tauuccuccgcccccucgatt

SEQ ID NO: 2147 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tucgaggaacccugcgcagtt

SEQ ID NO: 2148 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcucgaggaacccugcgcatt

SEQ ID NO: 2149 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccucgaggaacccugcgctt

SEQ ID NO: 2150 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggugccgcccucgaggaatt

SEQ ID NO: 2151 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
taucggugccgcccucgagtt

SEQ ID NO: 2152 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcaucggugccgcccucgatt

SEQ ID NO: 2153 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgggugagccggcgcucugtt

SEQ ID NO: 2154 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcccgauccccagcugautt

SEQ ID NO: 2155 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tggucaccacagcccgauctt

SEQ ID NO: 2156 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacgccuggcuuguugcggtt

SEQ ID NO: 2157 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tagacgccuggcuuguugctt

SEQ ID NO: 2158 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tacaucgguguagacgccutt

SEQ ID NO: 2159 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tcacaucgguguagacgcctt

SEQ ID NO: 2160 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tccacaucgguguagacgctt

SEQ ID NO: 2161 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgugugcucccggauccagtt

SEQ ID NO: 2162 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgagucccugagcaaucagtt

SEQ ID NO: 2163 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgaugagucccugagcaautt

SEQ ID NO: 2164 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tgcacuuuauugaguuccutt

SEQ ID NO: 2165 - DNA, 21 bp, artificial sequence
  antisense strand of an RNAi agent
  modified_base 2,4,6,8,10,12,14,16,18: /mod_base = "2'-deoxy-2'-fluoro corresponding nucleoside"
  modified_base 3,5,7,9,11,13,15,17,19: /mod_base = "2'-O-methyl corresponding nucleoside"
  modified_base 21: /mod_base = "5'-phosphorothioate corresponding nucleotide"
tagcacuuuauugaguucctt

SEQ ID NO: 2166 - RNA, 20 nt, artificial sequence
  sense strand of an RNAi agent
gcccaagaaagugaaagacc

SEQ ID NO: 2167 - RNA, 20 nt, artificial sequence
  sense strand of an RNAi agent
gcuuugagccucagcuucuc

SEQ ID NO: 2168 - RNA, 20 nt, artificial sequence
  sense strand of an RNAi agent
agcccaagaaagugaaagac

SEQ ID NO: 2169 - RNA, 20 nt, artificial sequence
  sense strand of an RNAi agent
ggagcccaagaaagugaaag

SEQ ID NO: 2170 - RNA, 20 nt, artificial sequence
  sense strand of an RNAi agent
gagcccaagaaagugaaaga

SEQ ID NO: 2171 - RNA, 20 nt, artificial sequence
  sense strand of an RNAi agent
cccaagaaagugaaagacca

SEQ ID NO: 2172 - RNA, 22 nt, artificial sequence
  antisense strand of an RNAi agent
ggucuuucacuuucuugggcuc

SEQ ID NO: 2173 - RNA, 22 nt, artificial sequence
  antisense strand of an RNAi agent
gagaagcugaggcucaaagcac

SEQ ID NO: 2174 - RNA, 22 nt, artificial sequence
  antisense strand of an RNAi agent
gucuuucacuuucuugggcucc

SEQ ID NO: 2175 - RNA, 22 nt, artificial sequence
  antisense strand of an RNAi agent
cuuucacuuucuugggcuccaa

SEQ ID NO: 2176 - RNA, 22 nt, artificial sequence
  antisense strand of an RNAi agent
ucuuucacuuucuugggcucca

SEQ ID NO: 2177 - RNA, 22 nt, artificial sequence
  antisense strand of an RNAi agent
uggucuuucacuuucuugggcu

SEQ ID NO: 2178 - RNA, 26 nt, artificial sequence
  antisense strand of an RNAi agent
uggucuuucacuuucuugggcucagu

SEQ ID NO: 2179 - RNA, 26 nt, artificial sequence
  antisense strand of an RNAi agent
uggucuuucacuuucuugggcuccaa

SEQ ID NO: 2180 - RNA, 26 nt, artificial sequence
  antisense strand of an RNAi agent
uggucuuucacuuucuugggcuccag

SEQ ID NO: 2181 - RNA, 26 nt, artificial sequence
  antisense strand of an RNAi agent
uggucuuucacuuucuugggcucgcg

SEQ ID NO: 2182 - DNA, 26 bp, artificial sequence
  antisense strand of an RNAi agent
  modified_base 1-25: /mod_base = "2'-hydroxy corresponding nucleoside"
uggucuuucacuuucuugggcucuat

SEQ ID NO: 2183 - RNA, 26 nt, artificial sequence
  sense strand of an RNAi agent
gacaugcccaagaaagugaaagacca

SEQ ID NO: 2184 - RNA, 26 nt, artificial sequence
  sense strand of an RNAi agent
gcgaugcccaagaaagugaaagacca

SEQ ID NO: 2185 - RNA, 26 nt, artificial sequence
  sense strand of an RNAi agent
ugaaugcccaagaaagugaaagacca

SEQ ID NO: 2186 - RNA, 26 nt, artificial sequence
  sense strand of an RNAi agent
uuggagcccaagaaagugaaagacca

SEQ ID NO: 2187 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
  modified_base 1: /mod_base = "5' end (SO3) modification"
uggucuuucacuuucuugggcucuau

SEQ ID NO: 2188 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
uggucuuucacuuucuugggcuccag

SEQ ID NO: 2189 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
uggucuuucacuuucuugggcucagu

SEQ ID NO: 2190 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
uggucuuucacuuucuugggcucgcg

SEQ ID NO: 2191 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,22,23: /mod_base = "5'-phosphorothioate corresponding nucleotide"
uggucuuucacuuucuugggcuccaa

SEQ ID NO: 2192 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15: /mod_base = "2'-O-methyl corresponding nucleoside"
  modified_base 18,19: /mod_base = "abasic corresponding nucleoside"
  modified_base 17: /mod_base = "locked nucleotide"
  modified_base 2,3: /mod_base = "5'-phosphorothioate corresponding nucleotide"
  modified_base 19: /mod_base = "3' end thioate(PaZ) modification"
ucuuucacuuucuugggnn

SEQ ID NO: 2193 - DNA, 19 bp, artificial sequence
  antisense strand of an RNAi agent
  modified_base 2,4,6,8,10,12,14: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 17: /mod_base = "locked nucleotide"
  modified_base 2,3: /mod_base = "5'-phosphorothioate corresponding nucleotide"
  modified_base 19: /mod_base = "3' end thioate(PaZ) modification"
ucuuucacuuucuugggnn

SEQ ID NO: 2194 - DNA, 19 bp, artificial sequence
  antisense strand of an RNAi agent
  modified_base 2,4,6,8,10,12,14: /mod_base = "2'-deoxy-2'-fluoro corresponding nucleoside"
  modified_base 1,3,5,7,9,11,13,15: /mod_base = "2'-O-methyl corresponding nucleoside"
  modified_base 18,19: /mod_base = "abasic corresponding nucleoside"
  modified_base 16,17: /mod_base = "locked nucleotide"
  modified_base 2,3: /mod_base = "5'-phosphorothioate corresponding nucleotide"
  modified_base 19: /mod_base = "3' end thioate(PaZ) modification"
ucuuucacuuucuugggnn

SEQ ID NO: 2195 - DNA, 26 bp, artificial sequence
  antisense strand of an RNAi agent
  modified_base 8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2: /mod_base = "2'-F-arabino nucleotide"
  modified_base 2,3,22,23: /mod_base = "5'-phosphorothioate corresponding nucleotide"
uggucuuucacuuucuugggcucuau

SEQ ID NO: 2196 - DNA, 26 bp, artificial sequence
  antisense strand of an RNAi agent
  modified_base 2,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 8: /mod_base = "2'-F-arabino nucleotide"
  modified_base 2,3,22,23: /mod_base = "5'-phosphorothioate corresponding nucleotide"
uggucuuucacuuucuugggcucuau

SEQ ID NO: 2197 - DNA, 26 bp, artificial sequence
  antisense strand of an RNAi agent
  modified_base 2,8,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 10: /mod_base = "2'-F-arabino nucleotide"
  modified_base 2,3,22,23: /mod_base = "5'-phosphorothioate corresponding nucleotide"
uggucuuucacuuucuugggcucuau

SEQ ID NO: 2198 - DNA, 26 bp, artificial sequence
  antisense strand of an RNAi agent
  modified_base 2,8,10: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 14: /mod_base = "2'-F-arabino nucleotide"
  modified_base 2,3,22,23: /mod_base = "5'-phosphorothioate corresponding nucleotide"
uggucuuucacuuucuugggcucuau

SEQ ID NO: 2199 - DNA, 19 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 18,19: /mod_base = "abasic corresponding nucleoside"
  modified_base 2,3,18: /mod_base = "5'-phosphorothioate corresponding nucleotide"
  modified_base 19: /mod_base = "3' end thioate(PaZ) modification"
ucuuucacuuucuugggnn

SEQ ID NO: 2200 - DNA, 17 bp, artificial sequence
  antisense strand of an RNAi agent
  modified_base 2,4,6,8,10,12,14,16: /mod_base = "2'-deoxy-2'-fluoro corresponding nucleoside"
  modified_base 1,3,5,7,9,11,13,15,17: /mod_base = "2'-O-methyl corresponding nucleoside"
  modified_base 2,3: /mod_base = "5'-phosphorothioate corresponding nucleotide"
  modified_base 17: /mod_base = "3' end thioate(c12)s(PaZ) modification"
ucuuucacuuucuuggg

SEQ ID NO: 2201 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,25,26: /mod_base = "2'-O-methyl corresponding nucleoside"
  modified_base 2,3,25,26: /mod_base = "5'-phosphorothioate corresponding nucleotide"
uggucuuucacuuucuugggcucuau

SEQ ID NO: 2202 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24,26: /mod_base = "2'-O-methyl corresponding nucleoside"
  modified_base 25: /mod_base = "3'-3'-linked nucleotide"
  modified_base 2,3: /mod_base = "5'-phosphorothioate corresponding nucleotide"
uggucuuucacuuucuugggcucuau

SEQ ID NO: 2203 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24: /mod_base = "2'-O-methyl corresponding nucleoside"
  modified_base 25,26: /mod_base = "2'-MOE nucleotide"
  modified_base 2,3: /mod_base = "5'-phosphorothioate corresponding nucleotide"
uggucuuucacuuucuugggcucuat

SEQ ID NO: 2204 - DNA, 26 bp, artificial sequence
  antisense strand of an RNAi agent
  modified_base 2,8,10,14: /mod_base = "2'-deoxy-2'-fluoro corresponding nucleoside"
  modified_base 1,3,4,5,6,7,9,11,12,13,15,16,17,18,19,20,21,22,23,24: /mod_base = "2'-O-methyl corresponding nucleoside"
  modified_base 25,26: /mod_base = "2'-MOE nucleotide"
  modified_base 2,3,25,26: /mod_base = "5'-phosphorothioate corresponding nucleotide"
uggucuuucacuuucuugggcucuat

SEQ ID NO: 2205 - DNA, 26 bp, artificial sequence
  antisense strand of an RNAi agent
  modified_base 25: /mod_base = "2'-hydroxy corresponding nucleoside"
  modified_base 2,8,10,14: /mod_base = "2'-deoxy-2'-fluoro corresponding nucleoside"
  modified_base 3,4,5,6,7,9,11,12,13,15,16,17,18,19,20,21,22,23,24,26: /mod_base = "2'-O-methyl corresponding nucleoside"
  modified_base 2,3,22,23: /mod_base = "5'-phosphorothioate corresponding nucleotide"
tggucuuucacuuucuugggcucuau

SEQ ID NO: 2206 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
gacaugcccaagaaagugaaagacca

SEQ ID NO: 2207 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
ugaaugcccaagaaagugaaagacca

SEQ ID NO: 2208 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
gcgaugcccaagaaagugaaagacca

SEQ ID NO: 2209 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uaugagcccaagaaagugaaagacca

SEQ ID NO: 2210 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 26: /mod_base = "3' end (Nag13) modification"
uuggagcccaagaaagugaaagacca

SEQ ID NO: 2211 - DNA, 17 bp, artificial sequence
  sense strand of an RNAi agent
  modified_base 5,7: /mod_base = "2'-deoxy-2'-fluoro corresponding nucleoside"
  modified_base 1,2,3,4,6,8,9,10,11,12,13,14,15,16: /mod_base = "2'-O-methyl corresponding nucleoside"
  modified_base 17: /mod_base = "locked nucleotide"
  modified_base 2,3: /mod_base = "5'-phosphorothioate corresponding nucleotide"
  modified_base 17: /mod_base = "3' end (Nag13) modification"
cccaagaaagugaaaga

SEQ ID NO: 2212 - DNA, 17 bp, artificial sequence
  sense strand of an RNAi agent
  modified_base 5,7: /mod_base = "2'-deoxy-2'-fluoro corresponding nucleoside"
  modified_base 1,2,3,4,6,8,9,10,11,12,13,14,15,17: /mod_base = "2'-O-methyl corresponding nucleoside"
  modified_base 16: /mod_base = "locked nucleotide"
  modified_base 2,3: /mod_base = "5'-phosphorothioate corresponding nucleotide"
  modified_base 17: /mod_base = "3' end (Nag13) modification"
cccaagaaagugaaaga

SEQ ID NO: 2213 - DNA, 17 bp, artificial sequence
  sense strand of an RNAi agent
  modified_base 5,7: /mod_base = "2'-deoxy-2'-fluoro corresponding nucleoside"
  modified_base 1,3,4,6,8,9,10,11,12,13,14,15,16,17: /mod_base = "2'-O-methyl corresponding nucleoside"
  modified_base 2: /mod_base = "locked nucleotide"
  modified_base 3: /mod_base = "5'-phosphorothioate corresponding nucleotide"
  modified_base 17: /mod_base = "3' end (Nag13) modification"
cccaagaaagugaaaga

SEQ ID NO: 2214 - DNA, 17 bp, artificial sequence
  sense strand of an RNAi agent
  modified_base 5,7: /mod_base = "2'-deoxy-2'-fluoro corresponding nucleoside"
  modified_base 2,3,4,6,8,9,10,11,12,13,14,15,16,17: /mod_base = "2'-O-methyl corresponding nucleoside"
  modified_base 1: /mod_base = "locked nucleotide"
  modified_base 2,3: /mod_base = "5'-phosphorothioate corresponding nucleotide"
  modified_base 17: /mod_base = "3' end (Nag13) modification"
cccaagaaagugaaaga

SEQ ID NO: 2215 - DNA, 17 bp, artificial sequence
  sense strand of an RNAi agent
  modified_base 5,7: /mod_base = "2'-deoxy-2'-fluoro corresponding nucleoside"
  modified_base 1,2,3,4,6,8,9,10,11,12,13,14,15: /mod_base = "2'-O-methyl corresponding nucleoside"
  modified_base 16,17: /mod_base = "locked nucleotide"
  modified_base 2,3: /mod_base = "5'-phosphorothioate corresponding nucleotide"
  modified_base 17: /mod_base = "3' end (Nag13) modification"
cccaagaaagugaaaga

SEQ ID NO: 2216 - DNA, 17 bp, artificial sequence
  sense strand of an RNAi agent
  modified_base 5,7: /mod_base = "2'-deoxy-2'-fluoro corresponding nucleoside"
  modified_base 3,4,6,8,9,10,11,12,13,14,15,16,17: /mod_base = "2'-O-methyl corresponding nucleoside"
  modified_base 1,2: /mod_base = "locked nucleotide"
  modified_base 3: /mod_base = "5'-phosphorothioate corresponding nucleotide"
  modified_base 17: /mod_base = "3' end (Nag13) modification"
cccaagaaagugaaaga

SEQ ID NO: 2217 - DNA, 17 bp, artificial sequence
  sense strand of an RNAi agent
  modified_base 5,7: /mod_base = "2'-deoxy-2'-fluoro corresponding nucleoside"
  modified_base 2,3,4,6,8,9,10,11,12,13,14,15,16: /mod_base = "2'-O-methyl corresponding nucleoside"
  modified_base 1,17: /mod_base = "locked nucleotide"
  modified_base 2,3: /mod_base = "5'-phosphorothioate corresponding nucleotide"
  modified_base 17: /mod_base = "3' end (Nag13) modification"
cccaagaaagugaaaga

SEQ ID NO: 2218 - DNA, 17 bp, artificial sequence
  sense strand of an RNAi agent
  modified_base 1,3,5,7,9,11,13,15: /mod_base = "2'-deoxy-2'-fluoro corresponding nucleoside"
  modified_base 2,4,6,8,10,12,14: /mod_base = "2'-O-methyl corresponding nucleoside"
  modified_base 16,17: /mod_base = "2'-MOE nucleotide"
  modified_base 2,3: /mod_base = "5'-phosphorothioate corresponding nucleotide"
  modified_base 17: /mod_base = "3' end (Nag13) modification"
cccaagaaagugaaaga

SEQ ID NO: 2219 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag18) modification"
uaugagcccaagaaagugaaagacca

SEQ ID NO: 2220 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag18) modification"
auagagcccaagaaagugaaagacca

SEQ ID NO: 2221 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag18) modification"
gacaugcccaagaaagugaaagacca

SEQ ID NO: 2222 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag18) modification"
ugaaugcccaagaaagugaaagacca

SEQ ID NO: 2223 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 7,8: /mod_base = "5'-phosphorothioate corresponding nucleotide"
  modified_base 1: /mod_base = "5' end (Nag18) modification"
gcgaugcccaagaaagugaaagacca

SEQ ID NO: 2224 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25: /mod_base = "2'-O-methyl corresponding nucleoside"
  modified_base 26: /mod_base = "3'-3'-linked nucleotide"
  modified_base 1: /mod_base = "5' end (Nag18) modification"
uauaugcccaagaaagugaaagacca

SEQ ID NO: 2225 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24: /mod_base = "2'-O-methyl corresponding nucleoside"
  modified_base 26: /mod_base = "3'-3'-linked nucleotide"
  modified_base 25: /mod_base = "2'-MOE nucleotide"
  modified_base 1: /mod_base = "5' end (Nag18) modification"
uauaugcccaagaaagugaaagacca

SEQ ID NO: 2226 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23: /mod_base = "2'-O-methyl corresponding nucleoside"
  modified_base 26: /mod_base = "3'-3'-linked nucleotide"
  modified_base 24,25: /mod_base = "2'-MOE nucleotide"
  modified_base 1: /mod_base = "5' end (Nag18) modification"
uauaugcccaagaaagugaaagacca

SEQ ID NO: 2227 - DNA, 26 bp, artificial sequence
  sense strand of an RNAi agent
  modified_base 14,16: /mod_base = "2'-deoxy-2'-fluoro corresponding nucleoside"
  modified_base 1,2,3,4,5,6,7,8,9,10,11,12,13,15,17,18,19,20,21,22,23,24,25,26: /mod_base = "2'-O-methyl corresponding nucleoside"
  modified_base 7,8: /mod_base = "5'-phosphorothioate corresponding nucleotide"
  modified_base 1: /mod_base = "5' end (alk-PEg4-c6) modification"
  modified_base 26: /mod_base = "3' end (Nag13) modification"
uauaugcccaagaaagugaaagacca

SEQ ID NO: 2228 - protein, 26 aa, Apis florea
GIGAILKVLATGLPTLISWIKNKRKQ

SEQ ID NO: 2229 - protein, 26 aa, Artificial Sequence
  Melittin-like peptide
AIGAILKVLATGLPTLISWIKNKRKQ

SEQ ID NO: 2230 - protein, 26 aa, Artificial Sequence
  Melittin-like peptide
CIGAILKVLATGLPTLISWIKNKRKQ

SEQ ID NO: 2231 - protein, 26 aa, Artificial Sequence
  Melittin-like peptide
FIGAILKVLATGLPTLISWIKNKRKQ

SEQ ID NO: 2232 - protein, 26 aa, Artificial Sequence
  Melittin-like peptide
HIGAILKVLATGLPTLISWIKNKRKQ

SEQ ID NO: 2233 - protein, 26 aa, Artificial Sequence
  Melittin-like peptide
IIGAILKVLATGLPTLISWIKNKRKQ

SEQ ID NO: 2234 - protein, 26 aa, Artificial Sequence
  Melittin-like peptide
LIGAILKVLATGLPTLISWIKNKRKQ

SEQ ID NO: 2235 - protein, 26 aa, Artificial Sequence
  Melittin-like peptide
  misc_feature (1)..(1): Xaa is Nle
XIGAILKVLATGLPTLISWIKNKRKQ

SEQ ID NO: 2236 - protein, 26 aa, Artificial Sequence
  Melittin-like peptide
VIGAILKVLATGLPTLISWIKNKRKQ

SEQ ID NO: 2237 - protein, 26 aa, Artificial Sequence
  Melittin-like peptide
WIGAILKVLATGLPTLISWIKNKRKQ

SEQ ID NO: 2238 - protein, 26 aa, Artificial Sequence
  Melittin-like peptide
YIGAILKVLATGLPTLISWIKNKRKQ

SEQ ID NO: 2239 - protein, 26 aa, Artificial Sequence
  D-form Apis florea melittin sequence
GIGAILKVLACGLPTLISWIKNKRKQ

SEQ ID NO: 2240 - protein, 26 aa, Artificial Sequence
  Melittin-like peptide
GIGAILKVLATLLPTLISWIKNKRKQ

SEQ ID NO: 2241 - protein, 26 aa, Artificial Sequence
  Melittin-like peptide
GIGAILKVLATWLPTLISWIKNKRKQ

SEQ ID NO: 2242 - protein, 26 aa, Artificial Sequence
  Melittin-like peptide
GIGAILKVLATGLPTLISWIKTKRKQ

SEQ ID NO: 2243 - protein, 26 aa, Artificial Sequence
  Melittin-like peptide
YIGAILNVLATGLPTLISWIKNKRKQ

SEQ ID NO: 2244 - protein, 26 aa, Artificial Sequence
  Melittin-like peptide
YIGAILAVLATGLPTLISWIKNKRKQ

SEQ ID NO: 2245 - protein, 26 aa, Artificial Sequence
  Melittin-like peptide
LIGAILSVLATGLPTLISWIKNKRKQ

SEQ ID NO: 2246 - protein, 26 aa, Artificial Sequence
  Melittin-like peptide
LIGAILRVLATGLPTLISWIKNKRKQ

SEQ ID NO: 2247 - protein, 26 aa, Artificial Sequence
  Melittin-like peptide
LIGAILHVLATGLPTLISWIKNKRKQ

SEQ ID NO: 2248 - protein, 26 aa, Artificial Sequence
  Melittin-like peptide
LIGAILKVLACGLPTLISWIKNKRKQ

SEQ ID NO: 2249 - protein, 26 aa, Artificial Sequence
  Melittin-like peptide
LIGAILKVLATLLPTLISWIKNKRKQ

SEQ ID NO: 2250 - protein, 26 aa, Artificial Sequence
  Melittin-like peptide
YIGAILKVLATGLLTLISWIKNKRKQ

SEQ ID NO: 2251 - protein, 26 aa, Artificial Sequence
  Melittin-like peptide
LIGAILKVLATGLPCLISWIKNKRKQ

SEQ ID NO: 2252 - protein, 26 aa, Artificial Sequence
  Melittin-like peptide
LIGAILKVLATGLPTLICWIKNKRKQ

SEQ ID NO: 2253 - protein, 26 aa, Artificial Sequence
  Melittin-like peptide
YIGAILKVLATGLPTLISAIKNKRKQ

SEQ ID NO: 2254 - protein, 26 aa, Artificial Sequence
  Melittin-like peptide
GIGAILKVLACGLPTLISWLKNKRKQ

SEQ ID NO: 2255 - protein, 26 aa, Artificial Sequence
  Melittin-like peptide
YIGAILKVLATGLPTLISWIANKRKQ

SEQ ID NO: 2256 - protein, 26 aa, Artificial Sequence
  Melittin-like peptide
YIGAILKVLATGLPTLISWIKNARKQ

SEQ ID NO: 2257 - protein, 26 aa, Artificial Sequence
  Melittin-like peptide
LIGAILKVLATGLPTLISWIKNKAKQ

SEQ ID NO: 2258 - protein, 26 aa, Artificial Sequence
  Melittin-like peptide
YIGAILKVLATGLPTLISWIKNKRAQ

SEQ ID NO: 2259 - protein, 26 aa, Artificial Sequence
  Melittin-like peptide
YIGAILKVLATGLPTLISWIKNKRKC

SEQ ID NO: 2260 - protein, 26 aa, Artificial Sequence
  Melittin-like peptide
LLGAILKVLACGLPTLISWIKNKRKQ

SEQ ID NO: 2261 - protein, 26 aa, Artificial Sequence
  Melittin-like peptide
LIGALLKVLACGLPTLISWIKNKRKQ

SEQ ID NO: 2262 - protein, 26 aa, Artificial Sequence
  Melittin-like peptide
YIGAILAVLATGLPTLISWIANKRKQ

SEQ ID NO: 2263 - protein, 26 aa, Artificial Sequence
  Melittin-like peptide
YIGAILAVLATGLPTLISWIKNARKQ

SEQ ID NO: 2264 - protein, 26 aa, Artificial Sequence
  Melittin-like peptide
LIGAILKVLACGLPTLLSWIKNKRKQ

SEQ ID NO: 2265 - protein, 26 aa, Artificial Sequence
  Melittin-like peptide
LIGAILKVLACGLPTLICWIKNKRKQ

SEQ ID NO: 2266 - protein, 26 aa, Artificial Sequence
  Melittin-like peptide
GIGAILKVLACGLPGLIGWIKNKRKQ

SEQ ID NO: 2267 - protein, 26 aa, Artificial Sequence
  Melittin-like peptide
GIGAILKVLACGLPALIAWIKNKRKQ

SEQ ID NO: 2268 - protein, 26 aa, Artificial Sequence
  Melittin-like peptide
YIGAILAVLATGLPTLISWIANARKQ

SEQ ID NO: 2269 - protein, 26 aa, Artificial Sequence
  Melittin-like peptide
YIAAILKVLAAALATLISWIKNKRKQ

SEQ ID NO: 2270 - protein, 26 aa, Artificial Sequence
  Melittin-like peptide
LLGALLKVLATGLPTLLSWLKNKRKQ

SEQ ID NO: 2271 - protein, 26 aa, Artificial Sequence
  Melittin-like peptide
  misc_feature 2, 5, 17, 20: Xaa is Nle
LXGAXLKVLATGLPTLXSWXKNKRKQ

SEQ ID NO: 2272 - protein, 26 aa, Artificial Sequence
  Melittin-like peptide
LVGAVLKVLATGLPTLVSWVKNKRKQ

SEQ ID NO: 2273 - protein, 26 aa, Artificial Sequence
  Melittin-like peptide
GLGALLKVLACGLPTLLSWLKNKRKQ

SEQ ID NO: 2274 - protein, 26 aa, Artificial Sequence
  Melittin-like peptide
  misc_feature 2, 5, 17, 20: Xaa is Nle
GXGAXLKVLACGLPTLXSWXKNKRKQ

SEQ ID NO: 2275 - protein, 31 aa, Artificial Sequence
  Melittin-like peptide
CEDDLLLGAILKVLATGLPTLISWIKNKRKQ

SEQ ID NO: 2276 - protein, 31 aa, Artificial Sequence
  Melittin-like peptide
CLVVLIVVAILKVLATGLPTLISWIKNKRKQ

SEQ ID NO: 2277 - protein, 26 aa, Apis mellifera
GIGAVLKVLTTGLPALISWIKRKRQQ

SEQ ID NO: 2278 - protein, 27 aa, Artificial Sequence
  Melittin-like peptide
CLIGAILKVLATGLPTLISWIKNKRKQ

SEQ ID NO: 2279 - protein, 27 aa, Artificial Sequence
  Melittin-like peptide
  misc_feature (2)..(2): Xaa is Nle
CXIGAILKVLATGLPTLISWIKNKRKQ

SEQ ID NO: 2280 - protein, 27 aa, Artificial Sequence
  Melittin-like peptide
GLIGAILKVLATGLPTLISWIKNKRKQ

SEQ ID NO: 2281 - protein, 27 aa, Artificial Sequence
  Melittin-like peptide
LLIGAILKVLATGLPTLISWIKNKRKQ

SEQ ID NO: 2282 - protein, 29 aa, Artificial Sequence
  Melittin-like peptide
KLKLIGAILKVLATGLPTLISWIKNKRKQ

SEQ ID NO: 2283 - protein, 29 aa, Artificial Sequence
  Melittin-like peptide
KLKYIGAILKVLATGLPTLISWIKNKRKQ

SEQ ID NO: 2284 - protein, 30 aa, Artificial Sequence
  Melittin-like peptide
CKLKLIGAILKVLATGLPTLISWIKNKRKQ

SEQ ID NO: 2285 - protein, 30 aa, Artificial Sequence
  Melittin-like peptide
  misc_feature (5)..(5): Xaa is Nle
CKLKXIGAILKVLATGLPTLISWIKNKRKQ

SEQ ID NO: 2286 - protein, 30 aa, Artificial Sequence
  Melittin-like peptide
GKLKLIGAILKVLATGLPTLISWIKNKRKQ

SEQ ID NO: 2287 - protein, 30 aa, Artificial Sequence
  D-form Melittin-like peptide
CPANLIGAILKVLATGLPTLISWIKNKRKQ

SEQ ID NO: 2288 - protein, 31 aa, Artificial Sequence
  Melittin-like peptide
DEPLRAIGAILKVLATGLPTLISWIKNKRKQ

SEQ ID NO: 2289 - protein, 27 aa, Artificial Sequence
  Melittin-like peptide
GIGAILKVLATGLPTLISWIKNKRKQC

SEQ ID NO: 2290 - protein, 27 aa, Artificial Sequence
  Melittin-like peptide
LIGAILKVLATGLPTLISWIKNKRKQC

SEQ ID NO: 2291 - protein, 27 aa, Artificial Sequence
  Melittin-like peptide
  misc_feature (1)..(1): Xaa is Nle
XIGAILKVLATGLPTLISWIKNKRKQC

SEQ ID NO: 2292 - protein, 30 aa, Artificial Sequence
  Melittin-like peptide
LIGAILKVLATGLPTLISWIKNKRKQKLKC

SEQ ID NO: 2293 - protein, 34 aa, Artificial Sequence
  Melittin-like peptide
YIGAILKVLATGLPTLISWIKNKRKQPLGIAGQC

SEQ ID NO: 2294 - protein, 31 aa, Artificial Sequence
  Melittin-like peptide
LIGAILKVLATGLPTLISWIKNKRKQKKKKK

SEQ ID NO: 2295 - protein, 31 aa, Artificial Sequence
  Melittin-like peptide
YIGAILKVLATGLPTLISWIKNKRKQGFKGC

SEQ ID NO: 2296 - protein, 30 aa, Artificial Sequence
  Melittin-like peptide
CFKLIGAILKVLATGLPTLISWIKNKRKQC

SEQ ID NO: 2297 - protein, 25 aa, Artificial Sequence
  Melittin-like peptide
FGAILKVLATGLPTLISWIKNKRKQ

SEQ ID NO: 2298 - protein, 23 aa, Artificial Sequence
  Melittin-like peptide
LIGAILKVLATGLPTLISWIKNK

SEQ ID NO: 2299 - protein, 21 aa, Artificial Sequence
  Melittin-like peptide
LIGAVLKVLTTGLPALISWIK

SEQ ID NO: 2300 - protein, 23 aa, Artificial Sequence
  Melittin-like peptide
LIGAVLKVLTTGLPALISWIKGE

SEQ ID NO: 2301 - protein, 26 aa, Artificial Sequence
  Melittin-like peptide
QKRKNKIWSILTPLGTALVKLIAGIL

SEQ ID NO: 2302 - protein, 29 aa, Artificial Sequence
  Melittin-like peptide
KLKQKRKNKIWSILTPLGTALVKLIAGIL

SEQ ID NO: 2303 - protein, 27 aa, Artificial Sequence
  Melittin-like peptide
GIGAVLKVLTTGLPALISWISRKKRQQ

SEQ ID NO: 2304 - protein, 25 aa, Artificial Sequence
  Melittin-like peptide
GIGARLKVLTTGLPRISWIKRKRQQ

SEQ ID NO: 2305 - protein, 26 aa, Artificial Sequence
  Melittin-like peptide
GIGAILKVLSTGLPALISWIKRKRQE

SEQ ID NO: 2306 - protein, 26 aa, Artificial Sequence
  Melittin-like peptide
GIGAVLKVLTTGLPALIGWIKRKRQQ

SEQ ID NO: 2307 - protein, 26 aa, Artificial Sequence
  Melittin-like peptide
GIGAVLKVLATGLPALISWIKRKRQQ

SEQ ID NO: 2308 - protein, 26 aa, Artificial Sequence
  Melittin-like peptide
GIGAVLKVLSTGLPALISWIKRKRQQ

SEQ ID NO: 2309 - protein, 26 aa, Artificial Sequence
  Melittin-like peptide
GIGAILRVLATGLPTLISWIKNKRKQ

SEQ ID NO: 2310 - protein, 26 aa, Artificial Sequence
  Melittin-like peptide
GIGAILKVLATGLPTLISWIKRKRKQ

SEQ ID NO: 2311 - protein, 26 aa, Artificial Sequence
  Melittin-like peptide
GIGAILKVLATGLPTLISWIKKKKQQ

SEQ ID NO: 2312 - protein, 32 aa, Artificial Sequence
  Melittin-like peptide
GIGAILKVLATGLPTLISWIKNKRKQGSKKKK

SEQ ID NO: 2313 - protein, 28 aa, Artificial Sequence
  Melittin-like peptide
KKGIGAILKVLATGLPTLISWIKNKRKQ

SEQ ID NO: 2314 - protein, 26 aa, Artificial Sequence
  Melittin-like peptide
GIGAILEVLATGLPTLISWIKNKRKQ

SEQ ID NO: 2315 - protein, 24 aa, Artificial Sequence
  Melittin-like peptide
GIGAVLKVLTTGLPALISWIKRKR

SEQ ID NO: 2316 - protein, 22 aa, Artificial Sequence
  Melittin-like peptide
GIGAVLKVLTTGLPALISWIKR

SEQ ID NO: 2317 - protein, 26 aa, Artificial Sequence
  Melittin-like peptide
CIGAVLKVLTTGLPALISWIKRKRQQ

SEQ ID NO: 2318 - protein, 26 aa, Artificial Sequence
  Melittin-like peptide
QQRKRKIWSILAPLGTTLVKLVAGIG

SEQ ID NO: 2319 - protein, 26 aa, Artificial Sequence
  Melittin-like peptide
QQRKRKIWSILAPLGTTLVKLVAGIC

SEQ ID NO: 2320 - protein, 26 aa, Artificial Sequence
  Melittin-like peptide
QQKKKKIWSILAPLGTTLVKLVAGIC

SEQ ID NO: 2321 - protein, 26 aa, Artificial Sequence
  Melittin-like peptide
QKRKNKIWSILTPLGTALVKLIAGIG

SEQ ID NO: 2322 - protein, 26 aa, Artificial Sequence
  Melittin-like peptide
QQRKRKIWSILAALGTTLVKLVAGIC

The invention claimed is:

1. An RNA interference (RNAi) trigger for inhibiting the expression of a Factor XII (F12) gene, wherein the RNAi trigger comprises a sense strand and an antisense strand, the antisense strand comprises nucleotides 2 to 19 (5' to 3') of SEQ ID NO:1417 (GGUCUUUCACUUUCUUGG), and wherein at least one nucleotide of the antisense strand is a modified nucleotide.

2. The RNAi trigger of claim 1 wherein the at least one modified nucleotide of the antisense strand is a 2'—O-methyl nucleotide, a 2'-fluoro nucleotide, a 2'-deoxy nucleotide, a 2',3'-seco nucleotide mimic, a locked nucleotide, a 2'-F-Arabino nucleotide, a 2'-methoxyethyl nucleotide, an abasic ribose, a ribitol, an inverted nucleotide, an inverted abasic nucleotide, an inverted 2-OMe nucleotide, an inverted 2'-deoxy nucleotide, a 2'-amino-modified nucleotide, a 2'-alkyl-modified nucleotide, a morpholino nucleotide, a vinyl phosphonate deoxyribonucleotide, or a 3'-OMe nucleotide.

3. The RNAi trigger of claim 1, wherein position 11, 12, and/or 13 from the 3' terminal end of the sense strand is a 2'-fluoro modified nucleotide.

4. The RNAi trigger of claim 1, wherein the antisense strand contains a 2'-fluoro modified nucleotide at position 2 from the 5' terminal end.

5. The RNAi trigger of claim 1, wherein the antisense strand contains a 2'-fluoro modified nucleotide at position 14 from the 5' terminal end.

6. The RNAi trigger of claim 1, wherein positions 4, 6, 8, 10, and/or 12 from the 5' terminal end of the antisense strand is a 2'-fluoro modified nucleotide.

7. The RNAi trigger of claim 1, wherein the RNAi trigger comprises one or more phosphorothioate internucleotide linkages.

8. The RNAi trigger of claim 1, wherein the sense strand comprises one or two phosphorothioate internucleotide linkages.

9. The RNAi trigger of claim 1, wherein the antisense strand contains one, two, three, or four phosphorothioate internucleotide linkages.

10. The RNAi trigger of claim 1, further comprising a targeting group conjugated to the sense strand.

11. The RNAi trigger molecule of claim 10, Wherein the targeting group comprises a cholesterol or cholesteryl derivative.

12. The RNAi trigger of claim 10, wherein a targeting group comprises an asialoglycoprotein receptor ligand.

13. The RNAi trigger of claim 12, wherein the asialoglycoprotein receptor ligand comprises a galactose cluster.

14. The RNAi trigger of claim 13, wherein the galactose cluster comprises an N-acetyl-galactosamine trimer.

15. The RNAi trigger of claim 1. wherein the RNAi trigger comprises AD01520 (SEQ ID NO: 1064 and SEQ ID NO: 693), AD02023 (SEQ ID NO: 1146 and SEQ ID NO: 791), AD00900 (SEQ ID NO: 986 and SEQ ID NO: 461), AD01001 (SEQ ID NO: 986 and SEQ ID NO: 604). AD02562 (SEQ ID NO: 1211 and SEQ ID NO: 772), AD02639 (SEQ ID NO: 1228 and SEQ ID NO: 791), AD02640 (SEQ ID NO: 1229 and SEQ ID NO: 791), AD02642 (SEQ ID NO: 1232 and SEQ ID NO: 791), AD02708 (SEQ ID NO: 1232 and SEQ ID NO: 827), AD02807 (SEQ ID NO: 1296 and SEQ ID NO: 791), AD02822 (SEQ ID NO: 1359 and SEQ ID NO: 830), AD02867 (SEQ ID NO: 1363 and SEQ ID NO: 791), or AD02868 (SEQ ID NO: 1364 and SEQ ID NO: 791).

16. The RNAi trigger of claim 1, wherein antisense strand comprises the nucleotide sequence of SEQ ID No: 177, SEQ ID No: 150, or SEQ ID No: 11.

17. The RNAi trigger of claim 1, wherein sense strand comprises the nucleotide sequence of SEQ ID NO: 1385, SEQ ID No. 374 or SEQ ID No. 379.

18. A composition comprising the RNA interference (RNAi) trigger molecule of claim 1 and at least one pharmaceutically acceptable excipient.

19. The composition of claim 18, wherein the at least one pharmaceutically acceptable excipient includes a delivery polymer.

20. The composition of claim 19, wherein the delivery polymer comprises a melittin-like peptide.

21. The composition of claim 18, further comprising a second therapeutic or treatment.

22. The composition of claim 18, wherein said composition is packaged in a kit, container, pack, dispenser, pre-filled syringes, or vials.

23. The composition of claim 18, wherein said composition is administered parenterally.

24. A method for inhibiting Factor XII expression in a subject comprising: administering to said subject a therapeutically effective amount of the RNA interference (RNAi) trigger of claim 1.

25. A method for the treatment of angioedema, including hereditary angioedema and venous thromboembolism, comprising administering to a patient in need of such treatment the composition of claim 18.

* * * * *